United States Patent 9,879,275 (NUCLEOTIDE SEQUENCES AND CORRESPONDING POLYPEPTIDES CONFERRING IMPROVED NITROGEN USE EFFICIENCY CHARACTERISTICS IN PLANTS) - sequence listing, part 2

SEQ ID NO: 2727 - protein, 152 aa, Solanum lycopersicum
  misc_feature: Ceres Annot ID no. 8458995
  misc_feature (1)..(152): Bit score of 279.7 for hmm based on sequences of FIGURE 37.
  misc_feature (27)..(49): Pfam Name: zf-C2H2 Pfam Description: Zinc finger, C2H2 type
  misc_feature: Functional Homolog Of SEQ ID NO. 1116
MANYLMLFSRQENHFNTMVNNSPSRVFECKTCNRQFSSFQALGGHRASHKKPRLMGEMNFHLPISPPKPKTHECSICGLEFPIGQALGGHMRRHRGMLNENNNNNNQVPNHDVMKKSSNNPRVLCLDLNLTPLENDLEFKLKKANPIVDCFL

SEQ ID NO: 2728 - DNA, 450 bp, Sorghum bicolor
  misc_feature: Ceres Annot ID no. 8631909
  misc_feature: Encodes the peptide sequence at SEQ ID NO. 2729
atggcgaagcacccgagagactccggcgccggcgccgtgccgctctccctcgcgctgtccctcggcggcggcggcgtggccgccgagcacggcagcaacaagaggcaccggcgcgcggcggcgggcggcggggacggcggcggcgagttcgtctgcaagacgtgcagccgcgccttcgggtcgttccaggcgctgggcgggcaccggaccagccacctgcggggccgccacggcctcgcgctcgggatgcccgcgccggcgaaggacgacgccaaggagaccaccacgaagcagccagcggcggcgtccgcgagccacctgtgccacgtctgcgggctcagcttcgagatgggccaggcgctcggcggccacatgcggcgccaccgcgaggaggccgccgccgccaccaccgcgcaggcgccgcccgtcctcctccagctcttcgtgtag

SEQ ID NO: 2729 - protein, 149 aa, Sorghum bicolor
  misc_feature: Ceres Annot ID no. 8631909
  misc_feature (1)..(149): Bit score of 116.5 for hmm based on sequences of FIGURE 37.
  misc_feature (50)..(72): Pfam Name: zf-C2H2 Pfam Description: Zinc finger, C2H2 type
  misc_feature: Functional Homolog Of SEQ ID NO. 1116
MAKHPRDSGAGAVPLSLALSLGGGGVAAEHGSNKRHRRAAAGGGDGGGEFVCKTCSRAFGSFQALGGHRTSHLRGRHGLALGMPAPAKDDAKETTTKQPAAASASHLCHVCGLSFEMGQALGGHMRRHREEAAAATTAQAPPVLLQLFV

SEQ ID NO: 2730 - DNA, 552 bp, Sorghum bicolor
  misc_feature: Ceres Annot ID no. 8631910
  misc_feature: Encodes the peptide sequence at SEQ ID NO. 2731
atgaagcacccgaggacggagcaggaggcggcgggcgaggtggtgtcgctggcgctgtcgctgagcacggactcgtccacgacgtccgactccacggggaccccgtcgtcggcgggggcgaagcgggcgcggcggaggggcgccgtggtggccacgtcgggggagggggagttcgtctgcaagacctgcagccgcgccttcacctcgttccaggcgctcggcggccaccggaccagccacctgcggggccgccacggcctcgagctcggcgtcggcgcccgggcgctcaagcagcacaagcaacaggccgccgccgccgaagccagcggcagaggaggagacaacaagccgccgcagcagcagcagcagcagcacgagtgccacatctgcgggctcggcttcgagatggggcaggcgctgggcggtcacatgaggaggcaccgcgaggagatgggcgccgccgaggccgccgacgcctgggtctggcgcaccgaggctccgcgcaccgctgccgccgccgatccgcccgtcttgctcgagctcttcgcctag

SEQ ID NO: 2731 - protein, 183 aa, Sorghum bicolor
  misc_feature: Ceres Annot ID no. 8631910
  misc_feature (1)..(183): Bit score of 120.3 for hmm based on sequences of FIGURE 37.
  misc_feature (58)..(80): Pfam Name: zf-C2H2 Pfam Description: Zinc finger, C2H2 type
  misc_feature: Functional Homolog Of SEQ ID NO. 1116
MKHPRTEQEAAGEVVSLALSLSTDSSTTSDSTGTPSSAGAKRARRRGAVVATSGEGEFVCKTCSRAFTSFQALGGHRTSHLRGRHGLELGVGARALKQHKQQAAAAEASGRGGDNKPPQQQQQQHECHICGLGFEMGQALGGHMRRHREEMGAAEAADAWVWRTEAPRTAAAADPPVLLELFA

SEQ ID NO: 2732 - DNA, 441 bp, Sorghum bicolor
  misc_feature: Ceres Annot ID no. 8631912
  misc_feature: Encodes the peptide sequence at SEQ ID NO. 2733
atgaagaggctcacgttcggacagcaggagcaggagccgggcgtcatcagcgtggcccagggcgtcatgctgctgctcgcgcgcagcggcggcggcgagccgtcggcctcgccgcgcgtgttcgagtgcaagacgtgcaaccgccggttcccgtcgttccaggcgctgggcgggcaccgcgcgagccacaagcgcccgcgggcagccgacgcggcggcagcgccggccaaggcgcgcgcgcacggctgcgcggtgtgcggcgtcgagttcgcgctcgggcaggcgctgggaggccacatgaggcgccaccgcgccgtggctgagggcgaggagcgggacggcgctgctagcgcccacgggctggacctgcacgacgccgaggcgaagccggaggaagcgagaggcctgctgggttttgacctcaacattgccccatcatga

SEQ ID NO: 2733 - protein, 146 aa, Sorghum bicolor
  misc_feature: Ceres Annot ID no. 8631912
  misc_feature (1)..(146): Bit score of 150.9 for hmm based on sequences of FIGURE 37.
  misc_feature (41)..(63): Pfam Name: zf-C2H2 Pfam Description: Zinc finger, C2H2 type
  misc_feature: Functional Homolog Of SEQ ID NO. 1116
MKRLTFGQQEQEPGVISVAQGVMLLLARSGGGEPSASPRVFECKTCNRRFPSFQALGGHRASHKRPRAADAAAAPAKARAHGCAVCGVEFALGQALGGHMRRHRAVAEGEERDGAASAHGLDLHDAEAKPEEARGLLGFDLNIAPS

SEQ ID NO: 2734 - DNA, 585 bp, Sorghum bicolor
  misc_feature: Ceres Annot ID no. 8669464
  misc_feature: Encodes the peptide sequence at SEQ ID NO. 2735
atggtcatgacgcttacgagacacgaagcggaggagagcaaggagatggagggcctccgggcgcacgccgaggcgctgctcacgctgtcggcgcccgcgtcgtcgtcgtcgttgggcaccggcggcacgccgccggcgccgtcctcggccgcggcccgcagggccatggcggccgagggcgtgttcgagtgcaagacgtgcagcaagcgcttcccgtcgttccaggcgctcggcgggcaccgcaccagccacacgcggctgcaggcgaggatgctcagcgacccagcggcggccgcggccgcggccgagagggacagggcgcgggtgcacgagtgcgccgtctgcggcctcgagttctccatgggccaggcgctcggcgggcacatgcgccgccacaggggcgaggcgccgccagccgcgcacgacgacgaccccgcgcaggcgcagccggaccgggacatgccggacctcaacttgccgccgctggacgacggcagcggcggcggtagcggcgatggccaaggtccacaacagtcggattatgatcgcggctcggagcctcagctgcttaatctgcttgtatag

SEQ ID NO: 2735 - protein, 194 aa, Sorghum bicolor
  misc_feature: Ceres Annot ID no. 8669464
  misc_feature (1)..(194): Bit score of 131.4 for hmm based on sequences of FIGURE 37.
  misc_feature (62)..(84): Pfam Name: zf-C2H2 Pfam Description: Zinc finger, C2H2 type
  misc_feature: Functional Homolog Of SEQ ID NO. 1116
MVMTLTRHEAEESKEMEGLRAHAEALLTLSAPASSSSLGTGGTPPAPSSAAARRAMAAEGVFECKTCSKRFPSFQALGGHRTSHTRLQARMLSDPAAAAAAAERDRARVHECAVCGLEFSMGQALGGHMRRHRGEAPPAAHDDDPAQAQPDRDMPDLNLPPLDDGSGGGSGDGQGPQQSDYDRGSEPQLLNLLV

SEQ ID NO: 2736 - DNA, 588 bp, Sorghum bicolor
  misc_feature: Ceres Annot ID no. 8724512
  misc_feature: Encodes the peptide sequence at SEQ ID NO. 2737
atggcgcgcgtgctgatgctcatgtcacactcgcacggccaggaccagtcgctgccgctgccggtgatcgccgccgggcgcggcgacggggcggcgccggagcgggtgttcgtgtgcaagacgtgcaaccgcgtgttcccgtcgttccaggcgctgggcggccaccgcgccagccacaagaagccgcggctggacggggacggcgaccccgcgctcgccaagcccaagctgcacggctgctccatctgcggcctcgagttcgccatcggccaggccctcggcggccacatgaggcgccaccgcgccatgacgggcggcatgcccatgccaccgccggcgacgacgaggatcgtcgtcgacaagaagccggacggcgacgtcgtcggcatcatccaccacgaccacggccacggcggcgtcaagcccggcgggctgtggctcgacctcaaccacccgccctgcgacgacgacggctgcgacgccgaggtggagtgcggccacattaatgccgccgccgccgccggtgggatcacgttccatcagttcctcgacactggcaccatggccgtcgactgccttggctactag

SEQ ID NO: 2737 - protein, 195 aa, Sorghum bicolor
  misc_feature: Ceres Annot ID no. 8724512
  misc_feature (1)..(195): Bit score of 226.6 for hmm based on sequences of FIGURE 37.
  misc_feature (37)..(59): Pfam Name: zf-C2H2 Pfam Description: Zinc finger, C2H2 type
  misc_feature: Functional Homolog Of SEQ ID NO. 1116
MARVLMLMSHSHGQDQSLPLPVIAAGRGDGAAPERVFVCKTCNRVFPSFQALGGHRASHKKPRLDGDGDPALAKPKLHGCSICGLEFAIGQALGGHMRRHRAMTGGMPMPPPATTRIVVDKKPDGDVVGIIHHDHGHGGVKPGGLWLDLNHPPCDDDGCDAEVECGHINAAAAAGGITFHQFLDTGTMAVDCLGY

SEQ ID NO: 2738 - DNA, 630 bp, Sorghum bicolor
  misc_feature: Ceres Annot ID no. 8733078
  misc_feature: Encodes the peptide sequence at SEQ ID NO. 2739
atggcggagaccgccggcgtgggcgtggacgcggccagcgttctcatgctgctctcgcggcggcaacaacaacaacaacaacaacaacaaggcggcgcgacgacgacggcggagctcggcgcgcgcgggcgcgggcgcgggcgcgggcgcgtgttcgagtgcaagacgtgcggcaggaggttcccgacgttccaggcgctgggcgggcaccgcgccagccacaggcgccccaagccctactactgcccctacccctacggcagcgaaccggggctacgccggacgaggctggacgagccgccgcacaacggcgagtgcgcgccgaggctacacggctgccccatctgcgggctcgagttcgcggtcggccaggcgctgggcgggcacatgcgtcggcaccggactgccgcagccgtctccggatgtgatgaactccgctctggggacgcgaacgcgacgtcggttgaggaagccgacgttggcgctgccgctggctgtgccggtggaatctgtttggacttgagcctggcgccgtcggagaactgcgtcaggtgccggaataacgctgtgctcggcaacacggcgcatgacgcacggaaatcgctgatattggactgccctcctctttga

SEQ ID NO: 2739 - protein, 209 aa, Sorghum bicolor
  misc_feature: Ceres Annot ID no. 8733078
  misc_feature (1)..(209): Bit score of 171.8 for hmm based on sequences of FIGURE 37.
  misc_feature (52)..(74): Pfam Name: zf-C2H2 Pfam Description: Zinc finger, C2H2 type
  misc_feature: Functional Homolog Of SEQ ID NO. 1116
MAETAGVGVDAASVLMLLSRRQQQQQQQQQGGATTTAELGARGRGRGRGRVFECKTCGRRFPTFQALGGHRASHRRPKPYYCPYPYGSEPGLRRTRLDEPPHNGECAPRLHGCPICGLEFAVGQALGGHMRRHRTAAAVSGCDELRSGDANATSVEEADVGAAAGCAGGICLDLSLAPSENCVRCRNNAVLGNTAHDARKSLILDCPPL

SEQ ID NO: 2740 - DNA, 697 bp, Triticum aestivum
  misc_feature: Ceres Clone ID no. 1057703
  misc_feature: Encodes the peptide sequence at SEQ ID NO. 2741
acatccacagccaattccgagctcttccgagtccctgaatccatctctcatctcctccatcgttccacagacgcacgagctctcgtcgagcaggccataccggactggctagccgagctccgatggtttcctcaatgaagcagtgcagagatgaggcccaggaggtgcccctgtccctctcgctctccctcggcgtcatggccgaccgcagcaagaagcagcgccgcggcggcgcagatggcgagttcgtctgcaagacgtgcagccgcgccttcccgtcgttccaggcgctgggcgggcaccggactagccacctccgcggccgccacgggctagcgctcggcctcacttcagggtccgatcagccggggaccaagaagacgacggaccagaagcaggcgcaccagtgccacgtctgcgggctggagttcgagatggggcaggcgatgggcggccacatgcgccgacaccgcgagcaggaggccgccaccacggcgcaggcgccgcccgttctgctccagctcttcgtctagcaccgcactgatttctctcaagttacatagctaggcatttctggttctagtagagatttacaggttggcctatgtgcgcggtttggtttgtacatttgctgcacactactgtagctcgttggtctgttcgctcttgttaggtatatatgcacatattttaggac

SEQ ID NO: 2741 - protein, 136 aa, Triticum aestivum
  misc_feature: Ceres Clone ID no. 1057703
  misc_feature (1)..(136): Bit score of 123.1 for hmm based on sequences of FIGURE 37.
  misc_feature (42)..(64): Pfam Name: zf-C2H2 Pfam Description: Zinc finger, C2H2 type
  misc_feature: Functional Homolog Of SEQ ID NO. 1116
MVSSMKQCRDEAQEVPLSLSLSLGVMADRSKKQRRGGADGEFVCKTCSRAFPSFQALGGHRTSHLRGRHGLALGLTSGSDQPGTKKTTDQKQAHQCHVCGLEFEMGQAMGGHMRRHREQEAATTAQAPPVLLQLFV

SEQ ID NO: 2742 - DNA, 766 bp, Arabidopsis thaliana
  misc_feature: Ceres Clone ID no. 114871
  misc_feature: Encodes the peptide sequence at SEQ ID NO. 2743
aatctcacaagtctcacattttctctaggtggaccaaccaaaacccaaaatcttcaatttcctctatcgtgctcttttctcttctcgacgcataacaaacagttccgtaaaaacatgaagagagaccggtccgattacgaagaatccatgaagcatatagacatagtagaaagtctaatgatgttatctcgaagtttcgtggtcaaacaaatcgatgtaaagcaatctaccggaagcaaaacgaaccataataaccacttcgaatgcaaaacgtgtaaccggaaatttgattccttccaagctcttggaggtcatagagctagccacaagaaacctaagctgatcgttgaccaagaacaggtgaagcatcgtaacaaagagaatgatatgcataagtgtacaatttgcgatcaaatgtttgggaccggtcaagctctaggcggtcacatgagaaagcataggacgagcatgataaccgagcaatcggttgtcccttctgtggtttattccagaccggttttaaatcgttgcagtagcagcaaggagatcttggacttaaatctaactccattggaaaatgatcttgtgttaatctttgggaagaatttggttccacaaattgatttgaagtttgtgaattagtagggtttttaattttgttctgtattttttgttgtaatagttttctctcttgccaaacattatttcattctttccgtcatatatgtatacacaatttgtttaaataaaaggtttcagttcttgc

SEQ ID NO: 2743 - protein, 175 aa, Arabidopsis thaliana
  misc_feature: Ceres Clone ID no. 114871
  misc_feature (1)..(175): Bit score of 160.7 for hmm based on sequences of FIGURE 37.
  misc_feature (49)..(71): Pfam Name: zf-C2H2 Pfam Description: Zinc finger, C2H2 type
  misc_feature: Functional Homolog Of SEQ ID NO. 1116
MKRDRSDYEESMKHIDIVESLMMLSRSFVVKQIDVKQSTGSKTNHNNHFECKTCNRKFDSFQALGGHRASHKKPKLIVDQEQVKHRNKENDMHKCTICDQMFGTGQALGGHMRKHRTSMITEQSVVPSVVYSRPVLNRCSSSKEILDLNLTPLENDLVLIFGKNLVPQIDLKFVN

SEQ ID NO: 2744 - DNA, 834 bp, Panicum virgatum
  misc_feature: Ceres Clone ID no. 1765978
  misc_feature: Encodes the peptide sequence at SEQ ID NO. 2745
agcagcaactcatcatccaacccgcctgctgatccgatccgagcttgattggcagcttcttcatccaagatcttgagctcgccatccgatccgagaacatcgttccgtcgtccatgacgaagcacccgagagacgccgccgccggcgacgtgaccctctccctggcgctctccctcggcggcctgcacgccggcgaacacggcccgagcaagaggccgcgccgcgcggccggcggcggcggcggcggcgagttcgtctgcaagacgtgcagccgcgccttcgcctcgttccaggcgctcggcgggcaccgcaccagccacctgcgcggccgccacggcctcgcgctcgggatgcccgccgcggcgccggcggccaagcagcagcctgcctcgaaggaccccaagaagcagcagcctgctgccagccaccaccagtgccacgtctgcgggctcggattcgagatggggcaggcgctcggcgggcacatgcggcggcaccgcgaggaggccgccgccgcggcacaggcgccgcccgtcctcctccagctgtttgtgtagagctggttcagtccatggatatagatttctctagaataattctttgcatttgtgtcgttctgtacattttgtagaacatttcgtagacatttgttggcatattggccgattcattcattcatccactaattacatgtaaagattactcattcgactctgatttcttatgactttatttagtttctttaaatctgtgcaagtgcgcatgggatcattatctgtctcccttgctgtctttgtaagagcaaatactcatgaagtactatgtattgcctct

SEQ ID NO: 2745 - protein, 147 aa, Panicum virgatum
  misc_feature: Ceres Clone ID no. 1765978
  misc_feature (1)..(147): Bit score of 118.9 for hmm based on sequences of FIGURE 37.
  misc_feature (47)..(69): Pfam Name: zf-C2H2 Pfam Description: Zinc finger, C2H2 type
  misc_feature: Functional Homolog Of SEQ ID NO. 1116
MTKHPRDAAAGDVTLSLALSLGGLHAGEHGPSKRPRRAAGGGGGGEFVCKTCSRAFASFQALGGHRTSHLRGRHGLALGMPAAAPAAKQQPASKDPKKQQPAASHHQCHVCGLGFEMGQALGGHMRRHREEAAAAAQAPPVLLQLFV

SEQ ID NO: 2746 - DNA, 762 bp, Panicum virgatum
  misc_feature: Ceres Clone ID no. 1872912
  misc_feature: Encodes the peptide sequence at SEQ ID NO. 2747
aacacaaccagaagctttttttggttgccgcgacctcacctgacccatccatcacccacacgcacaccacctgcagatcaacagcaacaagccagaagagatgaagcatccgagggagcagcagccgcaggaggaggtgtcgttggcgctgtcgctgagcacggcggactcgtgcacgacgacctccgactcgtccgccggggcgcccccggcggccaagtgcgcgcggcggcggaggggtccggtggtggccacatccggggagggggagttcgtctgcaagacctgcggccgcgccttcacctccttccaggcgctgggagggcaccggaccagccacctgcggggccgccacgggctcgagctcggcgtcggcgccaaggcgctcaggcagcacaaggcggccgccgccgccggcggcgacaagcaggagaagcagcagcaccagacccacgagtgccacatctgcgggctcggcttcgagttggggcaggcgctcggcggccacatgaggaggcaccgcgaggagatgggcgccgccgaggccgccgacgcatgggtctggcgcagcgtcgcgcgactaccggaggagctcgaggtccagagcgccgccgccgccggcccgcccgtcttgctcgagctcttcgcctagatcatcctccgtcgcccatcggattaattagacgcgcgtaggacatgtaaatgatattgtttggtctttcattaattagatctctttaggaattgagatcgttctctctt

SEQ ID NO: 2747 - protein, 183 aa, Panicum virgatum
  misc_feature: Ceres Clone ID no. 1872912
  misc_feature (1)..(183): Bit score of 134.6 for hmm based on sequences of FIGURE 37.
  misc_feature (58)..(80): Pfam Name: zf-C2H2 Pfam Description: Zinc finger, C2H2 type
  misc_feature: Functional Homolog Of SEQ ID NO. 1116
MKHPREQQPQEEVSLALSLSTADSCTTTSDSSAGAPPAAKCARRRRGPVVATSGEGEFVCKTCGRAFTSFQALGGHRTSHLRGRHGLELGVGAKALRQHKAAAAAGGDKQEKQQHQTHECHICGLGFELGQALGGHMRRHREEMGAAEAADAWVWRSVARLPEELEVQSAAAAGPPVLLELFA

SEQ ID NO: 2748 - DNA, 850 bp, Panicum virgatum
  misc_feature: Ceres Clone ID no. 1881106
  misc_feature: Encodes the peptide sequence at SEQ ID NO. 2749
accgcccagcacaaccagatcgaagcttttttggttgcctcgactcatccatcacacgcacacacaccacctgcgaacaagaagccagaagatgaagcatccgagggaccagcagcatcaggaggaggtgtcgctggcgctgtcgctgagcaccacgacgacggactcgtccaccacctccgactcgtccgccacggcgcccccggcggcggcggccaagcgcgcgcggaggcggaggggcccggtggtggccacctccggggagggcgacttcgtctgcaagacctgcagccgcgccttcacctccttccaggcgctgggagggcaccggaccagccacctgcggggccgccacgggctcgagctcggcgtcggcgccaaggcgctcaggcagcacaaggcggcggccggcggcggcgacaagcggcggcagcagcagcagcagcaccagacccacgattgccacatctgcgggctcggcttcgagttgggccaggcgctcggcggccacatgaggaggcaccgcgaggagatgggcgccgccgaggccgccgacgcttgggtctggcgcagcgtcgcacgcctcccggaggagctcgaggtccagagcgccgccgccgacccgcccgtcttgctcgagctgttcgcctagatcatcctccgttccgtccatcggattagccgcccctgatttcggccgggctgacgcgcgtaggccatgtaaatgatattgtttatttggtctcccattaattagatccttttaggaattgagatcgttctctcttaatttgtaactacagtatgctaggagttttgcattggttcgttgctgattagtggttccatc

SEQ ID NO: 2749 - protein, 186 aa, Panicum virgatum
  misc_feature: Ceres Clone ID no. 1881106
  misc_feature (1)..(186): Bit score of 137.0 for hmm based on sequences of FIGURE 37.
  misc_feature (61)..(83): Pfam Name: zf-C2H2 Pfam Description: Zinc finger, C2H2 type
  misc_feature: Functional Homolog Of SEQ ID NO. 1116
MKHPRDQQHQEEVSLALSLSTTTTDSSTTSDSSATAPPAAAAKRARRRRGPVVATSGEGDFVCKTCSRAFTSFQALGGHRTSHLRGRHGLELGVGAKALRQHKAAAGGGDKRRQQQQQHQTHDCHICGLGFELGQALGGHMRRHREEMGAAEAADAWVWRSVARLPEELEVQSAAADPPVLLELFA

SEQ ID NO: 2750 - DNA, 836 bp, Zea mays
  misc_feature: Ceres Clone ID no. 323750
  misc_feature: Encodes the peptide sequence at SEQ ID NO. 2751
gagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgccgtggtggccacgtcgggggagggcgagttcgtctgcaggrcctgcagccgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaagcagcggcacgagtgcaacgtctgcgggctcggcttcgagatgggccaggcgctgggcggccacatgcggaggcaccgcgaggaggagatgggcgccgccgacgcctgggtcaccctctggcgcaccgaggcgtcgcgcgccgccgacccgcccgtcttgctcgagctcttcgcttagatcgatccggccggcatagggtcgggctaatccctccttgttatttggggggaggctaactcgtcatctagacatctagtagcgtcggtagtttaatccaggacatgtaaatcgtattggttcgttcgttgccttttttttgtaattacgctagtatagtactagcttctgctgtgtttagcggttcggtcatggggccggttggattccgatacgaatgtcagagaactgatttcattcatactatattgctggaacatataacaggatcgatgattccttggttcc

SEQ ID NO: 2751 - protein, 173 aa, Zea mays
  misc_feature: Ceres Clone ID no. 323750
  misc_feature (1)..(173): Bit score of 90.5 for hmm based on sequences of FIGURE 37.
  misc_feature (56)..(78): Pfam Name: zf-C2H2 Pfam Description: Zinc finger, C2H2 type
  misc_feature: Functional Homolog Of SEQ ID NO. 1116
  misc_feature (60)..(60): Xaa is any aa, unknown, or other
MKHPRPTEQDVSLALSLSTDSSTTTSDSAGTPPAKRARARARRRGAVVATSGEGEFVCRXCSRAFPSFQALGGHRTSHLRAGRHGLDLGVVGARALKQHKQQAANANANGCEGGKQRHECNVCGLGFEMGQALGGHMRRHREEEMGAADAWVTLWRTEASRAADPPVLLELFA

SEQ ID NO: 2752 - DNA, 802 bp, Glycine max
  misc_feature: Ceres Clone ID no. 603406
  misc_feature: Encodes the peptide sequence at SEQ ID NO. 2753
attccaataactttgtcccttttcaatcactttgtcccttttcatacattcacatattcattttgccacaccttaaaaccaagcacccggccatatttcaatttttgttttggttagttgtcatgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattgattgatctgttcagtgtactgttaattaaacttaggaaggtatagtttgtgtatcatagataggtgaatgctttgtttttttaatctaccgtctatatttgtttatcatactgtatgaaaaattgctcatttcttgggcaaaattagaactcc

SEQ ID NO: 2753 - protein, 175 aa, Glycine max
  misc_feature: Ceres Clone ID no. 603406
  misc_feature (1)..(175): Bit score of 296.2 for hmm based on sequences of FIGURE 37.
  misc_feature (39)..(61): Pfam Name: zf-C2H2 Pfam Description: Zinc finger, C2H2 type
  misc_feature: Functional Homolog Of SEQ ID NO. 1116
MKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 2754 - DNA, 694 bp, Triticum aestivum
  misc_feature: Ceres Clone ID no. 701062
  misc_feature: Encodes the peptide sequence at SEQ ID NO. 2755
acatccacagccaattccgagctcttccgagtgactgcatccatctctcgtctccctctcccactccatcgttccgcaaagaactacgaactcttgttgagcaaatatccgactagccacgacatggtttcgtcaatgaagcatcacagagatgaggccggcgcttcctcgtccctctccctctcgctggccctcggcgccgtggccgaccgaagcaagaagatgcgccgcggcggcgtggacggcgagttcgtgtgcaagacgtgcggccgctcgtttccgtcattccaggctctgggcgggcaccggacaagccacctgcgcggccgccacgggctcgcgctcggcctcgctgccgggtccgataagccggcgaccaagaagaccacggaccagaagcaggcgcaccagtgccacatctgcgggctcgagttcgagatggggcaggcgcttggcggccacatgcgccggcaccgtgacgaggcggtcgccaccacggcgcaggcaccccccgttctgctccagctcttcgtctagctagctccattggtttctttctagtcgtaggtttactggttcacctgtgtgcacgattggatttgtacatttgctgcacactagtaagtgttgatcgctggttcattcgtccatattgacgaacacgtacatatttcgggacttgtccattcgttcg

SEQ ID NO: 2755 - protein, 137 aa, Triticum aestivum
  misc_feature: Ceres Clone ID no. 701062
  misc_feature (1)..(137): Bit score of 124.3 for hmm based on sequences of FIGURE 37.
  misc_feature (43)..(65): Pfam Name: zf-C2H2 Pfam Description: Zinc finger, C2H2 type
  misc_feature: Functional Homolog Of SEQ ID NO. 1116
MVSSMKHHRDEAGASSSLSLSLALGAVADRSKKMRRGGVDGEFVCKTCGRSFPSFQALGGHRTSHLRGRHGLALGLAAGSDKPATKKTTDQKQAHQCHICGLEFEMGQALGGHMRRHRDEAVATTAQAPPVLLQLFV

SEQ ID NO: 2756 - DNA, 985 bp, Zea mays
  misc_feature: Ceres Clone ID no. 919279
  misc_feature: Encodes the peptide sequence at SEQ ID NO. 2757
actcatccggacccatccgaaagcacctgcccatcagccttccttctcctagctttgtctcggttgtcttctggtcttgcgctctgctcttggactaatggcccatgggaagaggtctaggcagcaggccgagtcgacctcggtcagcctgctggacctggacagcggcgacatggcgcgcatcctgctgctcttctccggccaccaccagcaccacgcccactacgggccttcgtcgcccgagagggtgttcgagtgcaagacctgcagccggcggttcccgtccttccaggcgctcggcgggcaccgtgctagccacaagaagccgcgcctggcggacggcgccggcgctgagccgcccaagcccaaggtgcacggctgctccatctgcgggctcgagttcgccgtcggccaggcgctcggcggccacatgcgccgccaccgcgccgtcgcggcggcagggcccggcgtcgggcttggcctcagcctcggcctcgggccgaacgaggacggcaacaagaaggcggcggcggcggccgagctggcgctcgacctgaacgagccggcactggaggaggagccggccgatcgcgccatgcttgggctcgccgtgggattccccgtggtggttgactttcgacgttaggttgaacagaagaaatttgcgtctgaaccatacaaaattttgtactagttcaatacgtatttgcattgagctgctggagaagtcaacgacccttggaacattagaaatgctggctcgcgtatatacttttctgaagtctcaggggcaggggctctgtatttacaatgtttgacttctggcggtatttgtagtactagacgggttttttctcttctgtttcccctttttccacggggagttcagttttattttatgctccttggaggcatatctactacgtacgtatgaatatggctgtaaacctctcgaattacgagaatattataccaggatttattc

SEQ ID NO: 2757 - protein, 157 aa, Zea mays
  misc_feature: Ceres Clone ID no. 919279
  misc_feature (1)..(157): Bit score of 287.4 for hmm based on sequences of FIGURE 37.
  misc_feature (27)..(49): Pfam Name: zf-C2H2 Pfam Description: Zinc finger, C2H2 type
  misc_feature: Functional Homolog Of SEQ ID NO. 1116
MARILLLFSGHHQHHAHYGPSSPERVFECKTCSRRFPSFQALGGHRASHKKPRLADGAGAEPPKPKVHGCSICGLEFAVGQALGGHMRRHRAVAAAGPGVGLGLSLGLGPNEDGNKKAAAAAELALDLNEPALEEEPADRAMLGLAVGFPVVVDFRR

SEQ ID NO: 2758 - protein, 159 aa, Vitis vinifera
  misc_feature: Public GI ID no. 157337368
  misc_feature (1)..(159): Bit score of 304.3 for hmm based on sequences of FIGURE 37.
  misc_feature (41)..(63): Pfam Name: zf-C2H2 Pfam Description: Zinc finger, C2H2 type
  misc_feature: Functional Homolog Of SEQ ID NO. 1116
MKRSRVDGVDEVEALAMANCLMLLSRVGKSESTNQLPGRVFECKTCNRKFPSFQALGGHRASHKKPRLMGDELQLPTSPAKPKTHECSICGLEFAIGQALGGHMRRHRSEIHNPTPVSVVKKTSDERVLSLDLDLNLTPWENDLKIQFRKVPHMVDCIL

SEQ ID NO: 2759 - protein, 174 aa, Vitis vinifera
  misc_feature: Public GI ID no. 157344316
  misc_feature (1)..(174): Bit score of 334.2 for hmm based on sequences of FIGURE 37.
  misc_feature (38)..(60): Pfam Name: zf-C2H2 Pfam Description: Zinc finger, C2H2 type
  misc_feature: Functional Homolog Of SEQ ID NO. 1116
MKRMRDGEHESVSIANCLMLLSRGTDYDSIARVPSRVFECKTCNRQFPSFQALGGHRASHKKPRLMALNGDDPAQLQSSPLKPKTHECSICGLEFAIGQALGGHMRRHRAAASGATQALSETTSSSSPPPPQAPLLKKPNSRRVLCLDLNLTPLENIDLQFQLGKVASMVDCFP

SEQ ID NO: 2760 - protein, 135 aa, Triticum aestivum
  misc_feature: Public GI ID no. 160415774
  misc_feature (1)..(135): Bit score of 132.5 for hmm based on sequences of FIGURE 37.
  misc_feature (41)..(63): Pfam Name: zf-C2H2 Pfam Description: Zinc finger, C2H2 type
  misc_feature: Functional Homolog Of SEQ ID NO. 1116
MVSSMKHCRDQAPEVPLSLSLSLGAMADRSKKQGRGADGEFVCKTCSRAFPSFQALGGHRTSHLRARHGLALGLTGGSDQPATNKATDQKQAHQCHVCGLEFEMGQALGGHMRRHREQEAATTAQAPPVLLQLFV

SEQ ID NO: 2761 - protein, 176 aa, Triticum aestivum
  misc_feature: Public GI ID no. 167460244
  misc_feature (1)..(176): Bit score of 131.4 for hmm based on sequences of FIGURE 37.
  misc_feature (58)..(80): Pfam Name: zf-C2H2 Pfam Description: Zinc finger, C2H2 type
  misc_feature: Functional Homolog Of SEQ ID NO. 1116
MGAAVKRAREEEPVSLALALTTDSAASSTTSADSAGAAPARKRARRGRVVATSGEGEFVCKTCSRAFATFQALGGHRTSHLRGRHGLELGVGVARAIKERKKQEEKQHECHICGLGFEMGQALGGHMRRHREEMALRGGDDGDQWVWRGVGLPDQEAVAHQAAANYEPPVLLELFV

SEQ ID NO: 2762 - protein, 165 aa, Camellia sinensis
  misc_feature: Public GI ID no. 170522968
  misc_feature (1)..(165): Bit score of 310.6 for hmm based on sequences of FIGURE 37.
  misc_feature (43)..(65): Pfam Name: zf-C2H2 Pfam Description: Zinc finger, C2H2 type
  misc_feature: Functional Homolog Of SEQ ID NO. 1116
MTMAILKRSREDTEVEALAMANCLMLLSRVGETTSTKGRDRVFTCKTCNREFSSFQALGGHRASHKKLRLMGGGDLHVQTPSSPVKGKTHECSICGLEFAMGQALGGHMRRHRDSSSPSTAQAVIPVLKKSNSSNGSKRVLSLDLNLTPYENHMKIKKLPTWLIA

SEQ ID NO: 2763 - protein, 189 aa, Triticum aestivum
  misc_feature: Public GI ID no. 187236178
  misc_feature (1)..(189): Bit score of 259.6 for hmm based on sequences of FIGURE 37.
  misc_feature (43)..(65): Pfam Name: zf-C2H2 Pfam Description: Zinc finger, C2H2 type
  misc_feature: Functional Homolog Of SEQ ID NO. 1116
MTKRFAFEEKEMARVLLLVSQEQAMPMPMPMAVRGDRAPERVFVCKTCDRVFPSFQALGGHRASHKKPRLDDGGDLKPKLHGCSVCGLEFAIGQALGGHMRRHRAMVAGGGSGVMAMTPRTAAIKKHNDSSDNAVVGMKRGLWLDLNHPPCDEYGASCEGDDECGHDAAAAGYTFHQFLDTGTMEVDCV

SEQ ID NO: 2764 - protein, 196 aa, Populus x canescens
  misc_feature: Public GI ID no. 190609631
  misc_feature (1)..(196): Bit score of 346.7 for hmm based on sequences of FIGURE 37.
  misc_feature (52)..(74): Pfam Name: zf-C2H2 Pfam Description: Zinc finger, C2H2 type
  misc_feature: Functional Homolog Of SEQ ID NO. 1116
MKRDREQVELDLAKCLMLLSKVGEADHEILTSYRPAAAAATAGAGAGAGRSFSCKTCDKNFPSFQALGGHRASHKKPKLMESTGNLLKLPNSPSKPKTHQCSICGLEFPLGQALGGHMRRHRAPNNVDTTSNSSKDHELAAVTQPPFLPEAVPVLKRSNSSKRVLCLDLSLALPMYQNDSELQLEKVARPMLRCFI

SEQ ID NO: 2765 - DNA, 1680 bp, Solanum lycopersicum
  misc_feature: Ceres Annot ID no. 8460222
  misc_feature: Encodes the peptide sequence at SEQ ID NO. 2766
atggaggctgcagtagcggcagtagtgcaacatcctgtccctgcacaagttgctctgcgctactttacaattagtttgcatgtttacttcactgctgtttttcctttctgtaactgcttttctttcgtaaacaacgtagatgtatggttgtcatcagggatctgtggcaacttttttcttgcgaatgagtgtaattcggaagaggcaacaaccttagagcttgttattgtgcttttcgcctgtgataacactagggttggaaatgcttttgtgcagcagtattatcatattctgcaccattctcctggactggtttttaggttttatcaggatataagcaaacttggacgacctgaagatgatggctcaatgagcatcaccactactatggaagcaatcaatcataagatactctcactaaactatggggacttcagagcggagattaagtctgtggattcgcaagaatcctttaatgggggagtgcatgtctttgtgactggatctttgactgggaatgacaccttgattcggaatttctcccaaactttcttcctagcaccacaagaccgaggatactttgttctgaatgacatgtttcgatatgtagagagtgtcgatcaacatgatcccgctgaggtcccggagacggatgtggtggctcctgtcactcctgaactagcttcccctccagtgcagcaaaatcacatttccgagctgagtacactatcagtagaggaagctaatgagggagaaatctacaatccacctgagaatgctgatgtgcctgttgaagaggaagttcctgttgctgaggtcgttgatgaaatgcaagacgactctcaagtagaagttgagtctaacatcaaaagtgaagatactcctaagaagtcttacgcttcaattgtcatgcatctcaagggaagtgctgcgagtttctcctctcctccagcacctgcttctcggaagcccatggcaaggaatgttgagcaagtgaatcaacctcctgtaacagcaactgttcgcccagcttccagctcaaattctgttgataatgtgaataaccaggatggagaagtcacagatggctattcaatctacgtaaaaggtctgcctccgactgcaactgtggacttacttgctgatgagttcaagaagtttgggcctataaagaatggaggcattcaagttaaaaataatagagtattgctgcaacggttttcttatggtttcgtggaatttgaggaggcaagtgctttgcagaaagctattgaggcatctccaattttaattggaggacgtcaagcttatgttgaggagaagaagtctaccaattatcgaggcaatagcattatcgagaatggcctatgttctggtcactttagaggtagatttcaatctggagggggatctggttacaggaactatggagtaagaggccgaggaaactatggaggtggcaggggttatgctcgagatgattttggcgaaagaaccgagttcaacaacagaggtggacagcgcggatggtcgtctaatcgtgggggtgatggataccaatcataccagcgaactgataacacaggtggttatgttgtgcgtacgaatcgtggtgggggtatgcttaatggaactgccaaacacatgacaccacagggtattgctgcacctgtaatgtag

SEQ ID NO: 2766 - protein, 559 aa, Solanum lycopersicum
  misc_feature: Ceres Annot ID no. 8460222
  misc_feature (1)..(559): Bit score of 706.0 for hmm based on sequences of FIGURE 43.
  misc_feature (86)..(202): Pfam Name: NTF2 Pfam Description: Nuclear transport factor 2 (NTF2) domain
  misc_feature (366)..(438): Pfam Name: RRM_1 Pfam Description: RNA recognition motif. (a.k.a. RRM, RBD, or
  misc_feature: Functional Homolog Of SEQ ID NO. 1274
MEAAVAAVVQHPVPAQVALRYFTISLHVYFTAVFPFCNCFSFVNNVDVWLSSGICGNFFLANECNSEEATTLELVIVLFACDNTRVGNAFVQQYYHILHHSPGLVFRFYQDISKLGRPEDDGSMSITTTMEAINHKILSLNYGDFRAEIKSVDSQESFNGGVHVFVTGSLTGNDTLIRNFSQTFFLAPQDRGYFVLNDMFRYVESVDQHDPAEVPETDVVAPVTPELASPPVQQNHISELSTLSVEEANEGEIYNPPENADVPVEEEVPVAEVVDEMQDDSQVEVESNIKSEDTPKKSYASIVMHLKGSAASFSSPPAPASRKPMARNVEQVNQPPVTATVRPASSSNSVDNVNNQDGEVTDGYSIYVKGLPPTATVDLLADEFKKFGPIKNGGIQVKNNRVLLQRFSYGFVEFEEASALQKAIEASPILIGGRQAYVEEKKSTNYRGNSIIENGLCSGHFRGRFQSGGGSGYRNYGVRGRGNYGGGRGYARDDFGERTEFNNRGGQRGWSSNRGGDGYQSYQRTDNTGGYVVRTNRGGGMLNGTAKHMTPQGIAAPVM

SEQ ID NO: 2767 - DNA, 1440 bp, Solanum lycopersicum
  misc_feature: Ceres Annot ID no. 8460794
  misc_feature: Encodes the peptide sequence at SEQ ID NO. 2768
atggcagcggaagcagcagtagcagtagcggcagtagcaccagtttctgctcaagttgttgcgaatgcttttgtgcagcaatactatcatatattgcatcattcgccggggcttgtattcaggttttaccaggatataagcaagcttggacgtcctgaagaggatggatccatgggtatcactacgacaatgcaagcaataaatgataagatactctcactcaactatggagatctcagagcagagatcaagtctgtggatgcccaagaatcctttaatggcggggtgcatgtccttgtaactggatatttgactgggaaagacaacttggtccggaatttctgtcaaactttcttcctagcaccacaagatagggggtactttgtcttgaatgatatgtttcgatatgtagagactgccagtcagcatgatacagtccaggttccagtaactgatgctgtggctcctgtcacaccagagcaaaatccacctacagcaccacagaatcacattcctgagcaaagcactccaccagcagaggaagctgacgtgggagaagtttacaacccatctgagaatggtgatgtgcttattgttgaggaggaagtgcctgtgtctgaggtcgtccatgaagtccaagatggctctgaagtggtagcggaatctgacaacaaaactggggaagttcctaagaagtcatatgcttcaattgtcatgcatctcaaggaaagtgctgcaaccttctcccctcctccagcacctgctgctaggaagcctatgacaaagagtgttgtgcaagtgaatcagcctgctgccacaacaactgatggcccatattccagctcagagaccattgataacataaatgacacagaaggcatgcaactgcagacagctgatggctactcaatctatataaaaggcctgcctatgagtgcaactgtggcattacttgcggatgagttcaagaagtttgggccaataaaaaatggaggaattcaagtgagaagtaacaggcaacagggattttgttttggattcgtggaatttgaagtggaaagtgctgtgcaaaaagcaatcgaggcttctccagttctcattggtgatcggcaagcagtggtcgaggaaaagaggtctaccaattctcgacttaatgccagaggtggtggtaggtttcaatctggaaggggcggtggattcaggaacgatgttggaggaagagggcgaggaaactatttaggtggcaggggttatggtcgagatgatttccatggaagaaatgagttcaataacaggggtgggaatcgtgggggttcatcaaaccgtggaggtgaaggatatcggcgagctgacaatacaggtgggcgaatgagtcgtggtggtggaatgtctaatggaacagccaaaggcccggctcctcgctattctgctacagcttga

SEQ ID NO: 2768 - protein, 479 aa, Solanum lycopersicum
  misc_feature: Ceres Annot ID no. 8460794
  misc_feature (1)..(479): Bit score of 805.7 for hmm based on sequences of FIGURE 43.
  misc_feature (20)..(136): Pfam Name: NTF2 Pfam Description: Nuclear transport factor 2 (NTF2) domain
  misc_feature (304)..(374): Pfam Name: RRM_1 Pfam Description: RNA recognition motif. (a.k.a. RRM, RBD, or
  misc_feature: Functional Homolog Of SEQ ID NO. 1274
MAAEAAVAVAAVAPVSAQVVANAFVQQYYHILHHSPGLVFRFYQDISKLGRPEEDGSMGITTTMQAINDKILSLNYGDLRAEIKSVDAQESFNGGVHVLVTGYLTGKDNLVRNFCQTFFLAPQDRGYFVLNDMFRYVETASQHDTVQVPVTDAVAPVTPEQNPPTAPQNHIPEQSTPPAEEADVGEVYNPSENGDVLIVEEEVPVSEVVHEVQDGSEVVAESDNKTGEVPKKSYASIVMHLKESAATFSPPPAPAARKPMTKSVVQVNQPAATTTDGPYSSSETIDNINDTEGMQLQTADGYSIYIKGLPMSATVALLADEFKKFGPIKNGGIQVRSNRQQGFCFGFVEFEVESAVQKAIEASPVLIGDRQAVVEEKRSTNSRLNARGGGRFQSGRGGGFRNDVGGRGRGNYLGGRGYGRDDFHGRNEFNNRGGNRGGSSNRGGEGYRRADNTGGRMSRGGGMSNGTAKGPAPRYSATA

SEQ ID NO: 2769 - DNA, 1482 bp, Sorghum bicolor
  misc_feature: Ceres Annot ID no. 8697262
  misc_feature: Encodes the peptide sequence at SEQ ID NO. 2770
atggcgtcgccgccgccgccgccgcctcccgccgcagcctctgccccacccgccgcggcgtccggatcgccgccgccggcgcaagtggtgggcaacgccttcgtgcatcagtactacaacatcctgcaccagtcgccggagctcgtctaccgcttctaccaggaggccagccgcctcgggcgccccgccggcaccggcgccgacggcatggacacggtcaccaccatggacgcgattaacgagaagatcgtctcaatgggcatcgaccgggcggagatcaaggcggtggacgcacaggaatctctctgtggcggcgtcactgtgctcgtcatgggccaccttacggggaggaacggcgtcagccgcgagttcgtgcagtccttcttccttgcgccgcaggagaagggctacttcgttctcaacgacatactgcgctacgttggggagggggtaggggacgaggggaccaagcagcagccggcaccggaggttgctgcggatgtggagaccgccacccctgctcctatcctggccaacggcactgtcggaggggacacagggaccgtgcctcagaatgcttcgccgcagcccgagtgccaggtagctgagcctgcacttaatcaaaaggaggaagttgtgaacggggaggaggtttgtaacccgacaaatgatgtggagaagcctgttgttgaggaaacactggttcctgaggacataaatgaagtgccaaataatgtagcagtggctccaatttcatctccccctgtaccactggaggaggcaccaaagaagtcatatgcatcaattgtaaaagtgatgaaagaatatcgaccaccaggatctgcagttccttccaggcctgcacccctgaaaacagagaagcaagcgtctcctgcccccgctcaggttgctgatgctctagctttcacctctaatcctcagagtggcagctttcaagatccagaagttgatgcacatgccatatatgtgcgaagtctgccattaaatgccacaccacaacaattagaggaagagttcaagagatttggcgccattaaacatgaaggcatccaagttagaagcaataagatccaagggttttgttatggctttgtagaatttgaggatgccagtgcagttcaaactgcaatagaggcttctcctgttactattggtgaacggcaatgttatgttgaagaaaaaagaactaccggttctcgtggtggtagcaggggaggaaggttttcaccgggtagaggtggcaactttcgaggtgaaggcattagaggccgtggtacatacaatggaggtagagggtatggaaggggtgagttcagttatcgatctgattatggaggccgaggtggtggcaggggtggctcatcacgtggtgatgtcagctaccagcgggttgaccactctggtacagccagtggtcgtggtgcccgggcaccatcggctgccactgctgttgcaaagtga

SEQ ID NO: 2770 - protein, 493 aa, Sorghum bicolor
  misc_feature: Ceres Annot ID no. 8697262
  misc_feature (1)..(493): Bit score of 1107.9 for hmm based on sequences of FIGURE 43.
  misc_feature (30)..(146): Pfam Name: NTF2 Pfam Description: Nuclear transport factor 2 (NTF2) domain
  misc_feature (328)..(398): Pfam Name: RRM_1 Pfam Description: RNA recognition motif. (a.k.a. RRM, RBD, or
  misc_feature: Functional Homolog Of SEQ ID NO. 1274
MASPPPPPPPAAASAPPAAASGSPPPAQVVGNAFVHQYYNILHQSPELVYRFYQEASRLGRPAGTGADGMDTVTTMDAINEKIVSMGIDRAEIKAVDAQESLCGGVTVLVMGHLTGRNGVSREFVQSFFLAPQEKGYFVLNDILRYVGEGVGDEGTKQQPAPEVAADVETATPAPILANGTVGGDTGTVPQNASPQPECQVAEPALNQKEEVVNGEEVCNPTNDVEKPVVEETLVPEDINEVPNNVAVAPISSPPVPLEEAPKKSYASIVKVMKEYRPPGSAVPSRPAPLKTEKQASPAPAQVADALAFTSNPQSGSFQDPEVDAHAIYVRSLPLNATPQQLEEEFKRFGAIKHEGIQVRSNKIQGFCYGFVEFEDASAVQTAIEASPVTIGERQCYVEEKRTTGSRGGSRGGRFSPGRGGNFRGEGIRGRGTYNGGRGYGRGEFSYRSDYGGRGGGRGGSSRGDVSYQRVDHSGTASGRGARAPSAATAVAK

SEQ ID NO: 2771 - DNA, 1728 bp, Glycine max
  misc_feature: Ceres Clone ID no. 1169932
  misc_feature: Encodes the peptide sequence at SEQ ID NO. 2772
gacaaagatctcactcaattcaaccgcctccactctcacgcaaaccatttttcttttctttctctccctctgagcctttcatcgctgcctcggagagatggcagtgtcggaaggatcaccaacccctcagacggttggcaatgcttttgttgagcagtattactccatactgcatcaaaagccagaccaagttcacagattttaccacgagtctagcatcctaagccgacctgaagaagatggtaccatgactatggtgactactactttggaaattaataaaaagatactctctctggattacacaagctttagggtggaaattctgagtgctgatgcacagccttcttacaaggatggggtaattgttgtagtgactggctgcttaactggaagtgacaatctgaaaaggaagtttactcagtcctttttcctagctccccaggacaaaggctactttgttttgaatgatgttttcagatatgttgatgagtataagtcagttgatattgagtctgtgcctgcaaacgatgctgctgatgaaagtgctccaacagatgcttttgtccccgagcctgaggccattcatgttgctgaagatgttcccgctagtcaaactgatgttgttgatgctgacattggtgtcagtaaagaagtgagtcaaccactagagaatggaaatttatcagttactgaaaaggtggtgcctgttgatcatgttaaagaatgcagtcatcaggaacatcattcacacgctgagaaagctgcttctaataattcactggaggatactccaaagaagtcttttgcatccattgtgaatgcactaaaagaaaatgctgctcccttccatgtgagggtttcccctgtgaaacttcttgaacaaccacgtgtttctagtatacctgcaccagaagcaccagctcctagcactgacagtccaccagaaaagaataatgagattggaggtaaggcttatgcaatatttgttgcaaatttgcccatgaatgcaacagttgaacagctggaacgtgttttccagaaatttgggcccattaaacgggatggcattcaagttagaagtaacaagcaacaacaatcttgttttggttttgtggaatttgaatctgctacttcaatgcaaagtgcacttgaggcttctcctcctgttaccttggatggacgtagactttcaattgaagagcgacgagcaaataatgatagggggaggcattcatcaggaaggggcagttaccggaatgacagaaacgataacttcaggggccgtggcaacttcggtggtggccatggtggcggttatggaaacaggaaatgatagtttcgagaagcgaagcgagttctctggccggcctcgtggtggcaacaatggtgggcgtagcaatggagaagctgttccaaggagttatcagaatggaggagcaaaagtcactgtcaaccagtgaaagttcagtaaagtgattcattttgttgggaattgagtgacaacggcatttttcttatagatagcggcatctagggattctggtttgcaactgcattaagagttttttttctctattcctttatagctgtcatgatccttttgcttcagagtttttttggttaaatcacatcattccctatattcctttaaatcacattttgtatctaatattccggaataattgttttggaactgcccacaattatgccatttttttagaagcc

SEQ ID NO: 2772 - protein, 412 aa, Glycine max
  misc_feature: Ceres Clone ID no. 1169932
  misc_feature (1)..(412): Bit score of 729.8 for hmm based on sequences of FIGURE 43.
  misc_feature (13)..(129): Pfam Name: NTF2 Pfam Description: Nuclear transport factor 2 (NTF2) domain
  misc_feature (296)..(367): Pfam Name: RRM_1 Pfam Description: RNA recognition motif. (a.k.a. RRM, RBD, or
  misc_feature: Functional Homolog Of SEQ ID NO. 1274
MAVSEGSPTPQTVGNAFVEQYYSILHQKPDQVHRFYHESSILSRPEEDGTMTMVTTTLEINKKILSLDYTSFRVEILSADAQPSYKDGVIVVVTGCLTGSDNLKRKFTQSFFLAPQDKGYFVLNDVFRYVDEYKSVDIESVPANDAADESAPTDAFVPEPEAIHVAEDVPASQTDVVDADIGVSKEVSQPLENGNLSVTEKVVPVDHVKECSHQEHHSHAEKAASNNSLEDTPKKSFASIVNALKENAAPFHVRVSPVKLLEQPRVSSIPAPEAPAPSTDSPPEKNNEIGGKAYAIFVANLPMNATVEQLERVFQKFGPIKRDGIQVRSNKQQQSCFGFVEFESATSMQSALEASPPVTLDGRRLSIEERRANNDRGRHSSGRGSYRNDRNDNFRGRGNFGGGHGGGYGNRK

SEQ ID NO: 2773 - DNA, 1914 bp, Zea mays
  misc_feature: Ceres Clone ID no. 1552124
  misc_feature: Encodes the peptide sequence at SEQ ID NO. 2774
gcctccgcctccatctccttcgccaccagacctcaagcgcgccacacgccgccgcacgggagccgcgcgccgcacccgccgccgcttctcctcaaaaccagaggtctccccccgtcccccgatccagcgtctccatggccgcgccgcagcctgtcgcccccgcctccgaggcgccgccgtctgcgcaaatggtgggcaacgcgttcgtgcagcagtactacctcgtgctgcaccagtcgccggatctggtgtaccgcttctaccaggaggccagccgcctcgctcgccccgcatccgccgccggagccgccggcatggactcggtcaccaccatggaggcgatcagcgagaagataatggagatggacgtgtccaaagcggagatcaggacggtggactcgcaggagtctttaggcggcggcgtcgctgtgctcgtcacaggtcacctcaccggccgtgatggagtgcgccgcgagttctcgcaatccttcttcctcgcgccgcaggagatgggctacttcgtgctcaacgacatcttccgcttcgtcggggacatccctgcctctaccgccgttgaggcgcagccagaggcggttgctgtagtcccgcctgtggctgctccacttgccaacggcacagctactcctgctgtggagcctgccactcctgatgatcatggtgccgtgccacagcaggaacatcatgttgtggaccgatcactgcctcaacctgaagaggacgaggctgaggtttacaatccgccgcaagaggaagtagtggatgaggaacagcctgttgctgaagtgataaatgaagttccaaacaatgtggcacctgtggtggcaactacagttgcctcagtgttgcaggaggaggcaccaaagaagtcatacgcctcaattgtcaaaatcatgaaagaagttccattgcctgctcctgcgcctcctactaggccttcaccacccaaactagagaagcagtctcctcctcctgctactcctgtcacagatgtaccgcctttcagttctaaccccgagaacatcaatatccaagagcctgaagttgatgcacatgcaatatatgtgaggaatttacctttaaatgccactgaaactcaactggaggatgagttcaagaagtttggtaccattaagcaaaatggcattcaagtcagaagcaataagattcaagggttctgttatggattcgttgaattcgaggattctacttctgtccagagtgctatagaggcttcccctgtagcaattggcggtcgtcaatgttacgttgaggaaaagagagcacctggttcacgaggctccagcagaggcggcaggttcgcaccaggcaggggcaacaatttcagaagtgaaggtaccagagggcttggtaactacggtggaggaaggggctacgggaggggtgaatttagttacaggtctgattacggggtcagaagtggtggcagaggtggctcatcacgtggagctgatgttggctaccagagggttgaccatgctggatatgctggtggtcgtggtagccgcacagcagctgctggcgcaccttcaaaatgaggggcaccatagctgttgcgcgtcttttgggagtgttgttcggtggctctaagattattttgaagttggcatagaggctcatcaattggttcagtgcgggattacaagagaagcctggatacaaattatgagggttcctgtccttgatcattatttttgcaggcagcaaaaatggttactaattgagtaattgtagattagacacctattcagatgtagttctagtttcggtcgtcgactgatgtgccttgttgtcttttttgcaacgcatcatctaggtttttgttactgctggtattcatttattctgttgaattgaggttaatagcttttttag

SEQ ID NO: 2774 - protein, 480 aa, Zea mays
  misc_feature: Ceres Clone ID no. 1552124
  misc_feature (1)..(480): Bit score of 1103.2 for hmm based on sequences of FIGURE 43.
  misc_feature (20)..(137): Pfam Name: NTF2 Pfam Description: Nuclear transport factor 2 (NTF2) domain
  misc_feature (315)..(385): Pfam Name: RRM_1 Pfam Description: RNA recognition motif. (a.k.a. RRM, RBD, or
  misc_feature: Functional Homolog Of SEQ ID NO. 1274
MAAPQPVAPASEAPPSAQMVGNAFVQQYYLVLHQSPDLVYRFYQEASRLARPASAAGAAGMDSVTTMEAISEKIMEMDVSKAEIRTVDSQESLGGGVAVLVTGHLTGRDGVRREFSQSFFLAPQEMGYFVLNDIFRFVGDIPASTAVEAQPEAVAVVPPVAAPLANGTATPAVEPATPDDHGAVPQQEHHVVDRSLPQPEEDEAEVYNPPQEEVVDEEQPVAEVINEVPNNVAPVVATTVASVLQEEAPKKSYASIVKIMKEVPLPAPAPPTRPSPPKLEKQSPPPATPVTDVPPFSSNPENINIQEPEVDAHAIYVRNLPLNATETQLEDEFKKFGTIKQNGIQVRSNKIQGFCYGFVEFEDSTSVQSAIEASPVAIGGRQCYVEEKRAPGSRGSSRGGRFAPGRGNNFRSEGTRGLGNYGGGRGYGRGEFSYRSDYGVRSGGRGGSSRGADVGYQRVDHAGYAGGRGSRTAAAGAPSK

SEQ ID NO: 2775 - protein, 524 aa, Vitis vinifera
  misc_feature: Public GI ID no. 147842983
  misc_feature (1)..(524): Bit score of 881.3 for hmm based on sequences of FIGURE 43.
  misc_feature (49)..(165): Pfam Name: NTF2 Pfam Description: Nuclear transport factor 2 (NTF2) domain
  misc_feature (324)..(393): Pfam Name: RRM_1 Pfam Description: RNA recognition motif. (a.k.a. RRM, RBD, or
  misc_feature: Functional Homolog Of SEQ ID NO. 1274
  misc_feature (46)..(46): Xaa is any aa, unknown, or other
  misc_feature (208)..(208): Xaa is any aa, unknown, or other
  misc_feature (281)..(281): Xaa is any aa, unknown, or other
  misc_feature (283)..(283): Xaa is any aa, unknown, or other
MAQQAPAGSTHAAQVVCILILLTEPEIVFSFWLRLLLTGVNEILAXFQVGNAFVHQYYHILHQSPELVFRFYQDISKLGRLEENGIMGVTTTMEAINEKILSLNYGDLIAEIKSVDAQESFGGGVLVLVTGYLTGKDNRSRDFTQSFFLAPQDKGYFVLNDLFRYIEDVKYQDGNPGLVSEVEAPLTPEQDPSPVQENHILEPTPEVXEEVNEEVYNPSENGEASVEEEEAPVAEVVDEIQDDQMVTISDSKILEVPKKSYASIVKVMKESSVPFSSPTPXPXRPVPKIQEQQVTVAPLPTPGAEANAIENGNNQDGEADGHSIYIRGLPSNATPALLEDEFKKFGPIKSGGVQVRSNKQGFCFGFVEFEVASAVQSAMEASPITIGGRQAFVEEKRSTNMNNRTRFSNGRGVVFRNEGGRGRGNYGGNRGYNRGDFNSRSDFGNRGSRGGFPNRGGDGYQRTDHVGSNGGRVNRASGLTVNAAAKTTAPRVQMLLLEQKPFKCQHLSMPFSANGCHGKMLGLE

SEQ ID NO: 2776 - protein, 428 aa, Vitis vinifera
  misc_feature: Public GI ID no. 157328039
  misc_feature (1)..(428): Bit score of 782.1 for hmm based on sequences of FIGURE 43.
  misc_feature (16)..(132): Pfam Name: NTF2 Pfam Description: Nuclear transport factor 2 (NTF2) domain
  misc_feature (291)..(360): Pfam Name: RRM_1 Pfam Description: RNA recognition motif. (a.k.a. RRM, RBD, or
  misc_feature: Functional Homolog Of SEQ ID NO. 1274
MAQQAPAGSTHAAQVVGNAFVHQYYHILHQSPELVFRFYQDISKLGRLEENGIMGVTTTMEAINEKILSLNYGDLIAEIKSVDAQESFGGGVLVLVTGYLTGKDNRSRDFTQSFFLAPQDKGYFVLNDLFRYIEDVKYQDGNPGLVSEVEAPLTPEQDPSPVQENHILEPTPEVPEEVNEEVYNPSENGEASVEEEEAPVAEVVDEIQDDQMVTISDSKILEVPKKSYASIVKVMKESSVPFSSPTPIPPRPVPKIQEQQVTVAPLPTPGAEANAIENGNNQEGEADGHSIYIRGLPSNATPALLEDEFKKFGPIKSGGVQVRSNKQGFCFGFVEFEVASAVQSAMEASPITIGGRQAFVEEKRSTNMNNRTRFSNGRGVVFRNEGGRGRGNYGGNRGYNRGAIGEDFQIVEVMDIRGPIMWGAMVAV

SEQ ID NO: 2777 - protein, 457 aa, Vitis vinifera
  misc_feature: Public GI ID no. 157341261
  misc_feature (1)..(457): Bit score of 718.8 for hmm based on sequences of FIGURE 43.
  misc_feature (15)..(131): Pfam Name: NTF2 Pfam Description: Nuclear transport factor 2 (NTF2) domain
  misc_feature (304)..(374): Pfam Name: RRM_1 Pfam Description: RNA recognition motif. (a.k.a. RRM, RBD, or
  misc_feature: Functional Homolog Of SEQ ID NO. 1274
MQTENPQLPPSAEVVGNAFVEQYYYVLHRSPELVFRFYRDSSVMSWPDSNGLMSSVTTMQGINEKILSSEFKNRKTEIMTTDSQSSYEGGVIVLVTGCLMTKDKRRKKFTQSFFLAPQYNGYYVLNDVLRYIVDGEALETIPINGTNDSPAVSLNQGPGHTHDPDPPVPDPATSVVEDDEIVIEKVYDPLENEEQLVNEEEDFTETQSHPIENDDSTIAESSSSSAQEDAPKKSYASIVKVMKGSSGSTKVYVPTKTTKVTPAKTENQSPGLAAPAPVPESSVTSSINAPESSDAPEEVEGHSIYIRNLPLNVTVSQLEAEFQKFGPIKQGGVQVRSNKQQAYCFGFVEFLSLSSMHSAIQASPIIIGDHQAVVEIKRTTTRVGSGRGGRFPSGRGVFRGRGSFGGGRGFVRIEYGIRGEFSGRGRGPSGRSGGEGYRQGRGRAGRPSGHTQNAGSR

SEQ ID NO: 2778 - protein, 480 aa, Zea mays
  misc_feature: Public GI ID no. 194696592
  misc_feature (1)..(480): Bit score of 1104.4 for hmm based on sequences of FIGURE 43.
  misc_feature (20)..(137): Pfam Name: NTF2 Pfam Description: Nuclear transport factor 2 (NTF2) domain
  misc_feature (315)..(385): Pfam Name: RRM_1 Pfam Description: RNA recognition motif. (a.k.a. RRM, RBD, or
  misc_feature: Functional Homolog Of SEQ ID NO. 1274
MAAPQPVAPASEAPPSAQMVGNAFVQQYYLVLHQSPDLVYRFYQEASRLARPASAAGAAGMDSVTTMEAISEKIMEMDVSKAEIRTVDSQESLGGGVAVLVTGHLTGRDGVRREFSQSFFLAPQEMGYFVLNDIFRFVGDIPASTAVEAQPEAVAVVPPVAAPLANGTATPAVEPATPDDHGAVPQQEHHVVDRSLPQPEEDEAEVYNPPQEEVVDEEQPVAEVINEVPNNVAPVVATTVASVLQEEAPKKSYASIVKIMKEVPLPAPAPPTRPSPPKLEKQSPPPATPVTDVPPFSSNPENINIQEPEVDAHAIYVRNLPLNATETQLEDEFKKFGTIKQNGIQVRSNKIQGFCYGFVEFEDSTSVQSAIEASPVAIGGRQCYVEEKRAPGSRGSSRGGRFAPGRGNSFRSEGTRGRGNYGGGRGYGRGEFSYRSDYGVRSGGRGGSLRGADVGYQRVDHAGYAGGRGSRTAAAGAPSK

SEQ ID NO: 2779 - DNA, 261 bp, Sorghum bicolor
  misc_feature: Ceres Annot ID no. 8679543
  misc_feature: Encodes the peptide sequence at SEQ ID NO. 2780
atgcccacttggcacgttattgagaccgactgccgttcttctccatcttctcgttcgttccattctactggcataaggaggatgggggcgcacgctcatgatgagccatactacgtccacgccaagcacatgtacaacctgcacaggatgaagcaccagcaacttaaggtgtccctcgccgtgctggctgcggtaggcactggtgttggagtccctgtgtatgcagttgttttccagcagaagaagactgcatctgcataa

SEQ ID NO: 2780 - protein, 86 aa, Sorghum bicolor
  misc_feature: Ceres Annot ID no. 8679543
  misc_feature (1)..(86): Bit score of 146.9 for hmm based on sequences of FIGURE 19.
  misc_feature: Functional Homolog Of SEQ ID NO. 613
MPTWHVIETDCRSSPSSRSFHSTGIRRMGAHAHDEPYYVHAKHMYNLHRMKHQQLKVSLAVLAAVGTGVGVPVYAVVFQQKKTASA

SEQ ID NO: 2781 - DNA, 291 bp, Sorghum bicolor
  misc_feature: Ceres Annot ID no. 8700853
  misc_feature: Encodes the peptide sequence at SEQ ID NO. 2782
atgtgctctcttttattttctgttctccttgtatatcacccccagatatctgattttcttgttgtgcctacatcagcttctcgtgggttccatgccactggtgtgaagagaatgggaggacatggccatgacgagccatactacatccatgccaagcacatgtataacttgcacaggatgaagcatcaagggttgaaggtgactctttccgtgctgggagcggttagcatcggtgttggagtccctgtgtacgcagtcatattccagcagaagaagactgcctcaggttga

SEQ ID NO: 2782 - protein, 96 aa, Sorghum bicolor
  misc_feature: Ceres Annot ID no. 8700853
  misc_feature (1)..(96): Bit score of 176.2 for hmm based on sequences of FIGURE 19.
  misc_feature: Functional Homolog Of SEQ ID NO. 613
MCSLLFSVLLVYHPQISDFLVVPTSASRGFHATGVKRMGGHGHDEPYYIHAKHMYNLHRMKHQGLKVTLSVLGAVSIGVGVPVYAVIFQQKKTASG

SEQ ID NO: 2783 - DNA, 477 bp, Zea mays
  misc_feature: Ceres Clone ID no. 1524622
  misc_feature: Encodes the peptide sequence at SEQ ID NO. 2784
aggccaccaccacaccacaccacaccacaccaccggcggcggcggcgacccagtcgagaacacgaaggcgatggcgacagcgctgaaccgcgggctccgtctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcacaacaagactgcctctggctgagatgatgcctctcgctgcctgcatatggagacttattttgagcgacatttttttgaagttaaaagcttggacttcatcctatcttggctgtggagattggggaaaactcagcgctgataccatttgct

SEQ ID NO: 2784 - protein, 92 aa, Zea mays
  misc_feature: Ceres Clone ID no. 1524622
  misc_feature (1)..(92): Bit score of 194.2 for hmm based on sequences of FIGURE 19.
  misc_feature: Functional Homolog Of SEQ ID NO. 613
MATALNRGLRLLAAGAEASKPASRGFHATGVKRMGGHGHDEPYYIHAKHMYNLHRMKHQGLKVTLSVLGAVGIGVGVPVYAVIFQHNKTASG

SEQ ID NO: 2785 - DNA, 466 bp, Zea mays
  misc_feature: Ceres Clone ID no. 1688258
  misc_feature: Encodes the peptide sequence at SEQ ID NO. 2786
aggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgtcaccggcgtgaagagaatgggagggcatggccatgatgagccatactacatccatgccaagcacatgtataacttgcacaggatgaagcatcagggtttgaaggtgacactctttgtgctgggccccgccggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccat

SEQ ID NO: 2786 - protein, 92 aa, Zea mays
  misc_feature: Ceres Clone ID no. 1688258
  misc_feature (1)..(92): Bit score of 189.4 for hmm based on sequences of FIGURE 19.
  misc_feature: Functional Homolog Of SEQ ID NO. 613
MATALNRGLRLLAAGAEASKPASRGFHVTGVKRMGGHGHDEPYYIHAKHMYNLHRMKHQGLKVTLFVLGPAGIGVGVPVYAVIFQQKKTASG

SEQ ID NO: 2787 - DNA, 544 bp, Gossypium hirsutum
  misc_feature: Ceres Clone ID no. 1917008
  misc_feature: Encodes the peptide sequence at SEQ ID NO. 2788
aaaaagaagccaccgctttgtggaaacggcagccgtcgattgagtattttttttttgggtggaaaaagaaaagccatggcgttgaacggtggtcttagattggcttcgaagtttctgacttcgtcctctcaatcacttctctacaagtcagggaatagagggtttcattcaactggagtgaaaaggatgggaggagggcatgggcatgatgaaccatattacctccatgctaagcatatgtacaacttggataggatgaaaaaccagaagctgacaatgtcgcttggagttttgacagccttcagcattggcgtgtttgttcccgtctatgctgtcattttccagcagaaaaagactgcatctggttgattttttatggttgccttcttggcatggtttggctgcctgcaataatggaagcaactgccattgtgatcttcagcttttgaactgatgtagtttaatgattatgatgatacttgcaggattttagtatttctgttggcaatcaactgttggtaattatgggaattgattatttgat

SEQ ID NO: 2788 - protein, 97 aa, Gossypium hirsutum
  misc_feature: Ceres Clone ID no. 1917008
  misc_feature (1)..(97): Bit score of 187.9 for hmm based on sequences of FIGURE 19.
  misc_feature: Functional Homolog Of SEQ ID NO. 613
MALNGGLRLASKFLTSSSQSLLYKSGNRGFHSTGVKRMGGGHGHDEPYYLHAKHMYNLDRMKNQKLTMSLGVLTAFSIGVFVPVYAVIFQQKKTASG

SEQ ID NO: 2789 - DNA, 608 bp, Zea mays
  misc_feature: Ceres Clone ID no. 237799
  misc_feature: Encodes the peptide sequence at SEQ ID NO. 2790
aaaaaaatcacaccgaatcaccctctcgcccaccaccacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggggaaaactcagcgctgaaaaaaaaatc

SEQ ID NO: 2790 - protein, 96 aa, Zea mays
  misc_feature: Ceres Clone ID no. 237799
  misc_feature (1)..(96): Bit score of 219.4 for hmm based on sequences of FIGURE 19.
  misc_feature: Functional Homolog Of SEQ ID NO. 613
MATALNRGLRSGLRLLAAGAEASKPASRGFHATGVKRMGGHGHDEPYYIHAKHMYNLHRMKHQGLKVTLSVLGAVGIGVGVPVYAVIFQQKKTASG

SEQ ID NO: 2791 - DNA, 567 bp, Triticum aestivum
  misc_feature: Ceres Clone ID no. 633782
  misc_feature: Encodes the peptide sequence at SEQ ID NO. 2792
agatcggttaaatcacccccaaaacgcacccaccaccacaactccggcggcggcgaccagacgaacacgagcaccaaggcgatggcgactgctctcaaccgcggcctccgctccgggatccgcctcctcgccaccggcgccgaggcctccaagccagcttcacgtggattccatgctaccggtgtgaagaggatgtcagggcatggccatgatgagccatactacctccacgccaagcacatgtacaacttgcacaggatgaagcatcagaagctgactgcatggacttcggtgctgggagctgtaagcattggtgtcggtgtcccggtcttcgcggtcgtcttccagcaaaagaagacctcctcgggctgagcttacatgccccctccctgggcctacttgttggatctattttgaatttagcattttgtgaagccaaagctgtcacttcaccttactcttgttgtttcgtgttactccatttgctgttagcagatgatctgaatcttaagctcgtttctttacggcactgctttctgttaataatacaagtggcttgaactttcc

SEQ ID NO: 2792 - protein, 96 aa, Triticum aestivum
  misc_feature: Ceres Clone ID no. 633782
  misc_feature (1)..(96): Bit score of 214.1 for hmm based on sequences of FIGURE 19.
  misc_feature: Functional Homolog Of SEQ ID NO. 613
MATALNRGLRSGIRLLATGAEASKPASRGFHATGVKRMSGHGHDEPYYLHAKHMYNLHRMKHQKLTAWTSVLGAVSIGVGVPVFAVVFQQKKTSSG

SEQ ID NO: 2793 - DNA, 486 bp, Brassica napus
  misc_feature: Ceres Clone ID no. 871052
  misc_feature: Encodes the peptide sequence at SEQ ID NO. 2794
atctttttagctgttactcgatcaattttctgataatggcgttgaacaccggaatcagatcgatctcaaagatcatagcttcatccgagtcattagtctccagatctgtgagcagaagcttccactcgactggagctaagaagatgagcggagggcatggccatgacgagccatactacctccacgcaaagcacatgtacaatttggaccgcatgaagtaccaaggtctcaagatgtctctcggtgtcttcacagctttcagcatcggtgttggagttcctatctttgctgttgtcttccagcaaaggaagaccgcatctggttgagttgagtctctcttctcagcttgaataatatttgtatgggaattttcaaactctgcctctgcaaggaaagtctcttgcttctcttttttgatcttagccccaagtcttatcgttataaaagtatattattcatcttcttttgctggctgtttgatsctgg

SEQ ID NO: 2794 - protein, 96 aa, Brassica napus
  misc_feature: Ceres Clone ID no. 871052
  misc_feature (1)..(96): Bit score of 217.9 for hmm based on sequences of FIGURE 19.
  misc_feature: Functional Homolog Of SEQ ID NO. 613
MALNTGIRSISKIIASSESLVSRSVSRSFHSTGAKKMSGGHGHDEPYYLHAKHMYNLDRMKYQGLKMSLGVFTAFSIGVGVPIFAVVFQQRKTASG

SEQ ID NO: 2795 - protein, 100 aa, Picea sitchensis
  misc_feature: Public GI ID no. 116778505
  misc_feature (1)..(100): Bit score of 169.2 for hmm based on sequences of FIGURE 19.
  misc_feature: Functional Homolog Of SEQ ID NO. 613
MANVTAASNALKRGLNLLAPSNAALRRPVSRSVHSTGCKKMAEHGEHAEPFYIHAEHMYNLDRMKHQKLKMGLAVWACFGIGVGVPIFAVVFQQKKTASG

SEQ ID NO: 2796 - protein, 96 aa, Populus balsamifera subsp. trichocarpa
  misc_feature: Public GI ID no. 118481348
  misc_feature (1)..(96): Bit score of 203.8 for hmm based on sequences of FIGURE 19.
  misc_feature: Functional Homolog Of SEQ ID NO. 613
MALNNGLRSASKLFTASESLLSKSVNRGIHSTGVKRMGGGHGHDEPFYLHAKHMYNLDRMKYQKIKMPIAVFTAFSIGVLVPIYAVIFQQKKTASG

SEQ ID NO: 2797 - protein, 100 aa, Vitis vinifera
  misc_feature: Public GI ID no. 147772939
  misc_feature (1)..(100): Bit score of 169.3 for hmm based on sequences of FIGURE 19.
  misc_feature: Functional Homolog Of SEQ ID NO. 613
  misc_feature (23)..(23): Xaa is any aa, unknown, or other
MALNSGLRSASQLFKSSQQLVSXSVNRGFHSTGVKRMGEGHGHGHGHDEPFYLHAKHMYNLDRMKYQKVQVPLAVLGVVCTGVGVPIFAVVYQQSKTASA

SEQ ID NO: 2798 - protein, 106 aa, Vitis vinifera
  misc_feature: Public GI ID no. 157356020
  misc_feature (1)..(106): Bit score of 163.0 for hmm based on sequences of FIGURE 19.
  misc_feature: Functional Homolog Of SEQ ID NO. 613
MALNSGLRSASQLFKSSQQLVSKSVNRGFHSTGVKRMGEGHGHGHGHGHGHGHDEPFYLHAKHMYNLDRMKYQKVQVPLAVLGVVCTGVGVPIFAVVYQQSKTASA

SEQ ID NO: 2799 - protein, 92 aa, Primula vulgaris
  misc_feature: Public GI ID no. 89887312
  misc_feature (1)..(92): Bit score of 163.6 for hmm based on sequences of FIGURE 19.
  misc_feature: Functional Homolog Of SEQ ID NO. 613
MAMRSCASKLFFSSQPFLHNSASRGFHATGAKRMSAHERDGEYYLHAKHMYNLDRMKYQKLTMSLAVLTAFSIGVGVPVFAVVFQQKKTASG

SEQ ID NO: 2800 - protein, 92 aa, Primula vulgaris
  misc_feature: Public GI ID no. 89887314
  misc_feature (1)..(92): Bit score of 170.3 for hmm based on sequences of FIGURE 19.
  misc_feature: Functional Homolog Of SEQ ID NO. 613
MAMRSCASKLFSSSQPLLHNSASRGFHATGAKRMSAHGHDGEYYLHAKRMYNLDRMKYQKLTMSLAVLTAFSIGVGVPVFAVVFQQKKTASG

SEQ ID NO: 2801 - protein, 92 aa, Primula vulgaris
  misc_feature: Public GI ID no. 89887316
  misc_feature (1)..(92): Bit score of 166.8 for hmm based on sequences of FIGURE 19.
  misc_feature: Functional Homolog Of SEQ ID NO. 613
MAMRSCASKLFSSSQPLLHNSASRGFHATGAKRMSAHERDGEYYLHAKHMYNLDRMKYQKLTMSLAVLTAFSIGVGVPVFAVVFQQKKTASG

SEQ ID NO: 2802 - protein, 92 aa, Primula vulgaris
  misc_feature: Public GI ID no. 89887336
  misc_feature (1)..(92): Bit score of 168.9 for hmm based on sequences of FIGURE 19.
  misc_feature: Functional Homolog Of SEQ ID NO. 613
MAMRSCASKLLFSSQPFLHNSASRGFHATGAKRMSAHEHDGEYYLHAKHMYNLDRMKYQKLTMSLAVLTAFSIGVGVPVFAVVFQQKKTASG

SEQ ID NO: 2803 - protein, 92 aa, Primula vulgaris
  misc_feature: Public GI ID no. 89887338
  misc_feature (1)..(92): Bit score of 174.4 for hmm based on sequences of FIGURE 19.
  misc_feature: Functional Homolog Of SEQ ID NO. 613
MAMRSCASKLFSSSQPLLHNSASRGFHATGAKRMSAHGHDGEYYLHAKHMYNLDRMKYQKLTMSLAVLTAFSIGVGVPVFAVVFQQKKTASG

SEQ ID NO: 2804 - protein, 92 aa, Primula vulgaris
  misc_feature: Public GI ID no. 89887340
  misc_feature (1)..(92): Bit score of 166.8 for hmm based on sequences of FIGURE 19.
  misc_feature: Functional Homolog Of SEQ ID NO. 613
MAMRSCASKLFFSSQPFLHNSASRGFHATGAKRMSAHEHDGEYYLHAKHMYNLDRMKYQKLTMSLAVLTAFSIGVGVPVFAVVFQQKKTASG

SEQ ID NO: 2805 - DNA, 447 bp, Solanum lycopersicum
  misc_feature: Ceres Annot ID no. 8454798
  misc_feature: Encodes the peptide sequence at SEQ ID NO. 2806
atggcctcttcggccaccggcgaacctttgccggcaaactattactacggtacatttcaaggagtagcaaatcatccgcctcctcctccacagtctcacccggtgttcggttttcctcagcccgttcctcctcctggtgtcgccggcgctcctcctcaatactatcctcagggttatcaaactgttcacggttatgctgttgctgaaggtagacctatgagggagcaccgtcttccttgctgtggtgtggggatcggctgggtcttgttcatctctggtttctttcttggtaccataccttggtatgttggagcttttcttcttttgtgtgtacggatcgattatagagagaaggctggccttatagcatgcacattagggcctcacacttgtaatactggcttaacgtcagaagtatgctctcatttctatctactggcattatga

SEQ ID NO: 2806 - protein, 148 aa, Solanum lycopersicum
  misc_feature: Ceres Annot ID no. 8454798
  misc_feature (1)..(148): Bit score of 204.6 for hmm based on sequences of FIGURE 09.
  misc_feature: Functional Homolog Of SEQ ID NO. 218
MASSATGEPLPANYYYGTFQGVANHPPPPPQSHPVFGFPQPVPPPGVAGAPPQYYPQGYQTVHGYAVAEGRPMREHRLPCCGVGIGWVLFISGFFLGTIPWYVGAFLLLCVRIDYREKAGLIACTLGPHTCNTGLTSEVCSHFYLLAL

SEQ ID NO: 2807 - DNA, 414 bp, Sorghum bicolor
  misc_feature: Ceres Annot ID no. 8658234
  misc_feature: Encodes the peptide sequence at SEQ ID NO. 2808
atgagcggggaggaggccgacggctccaagccccaccagggaggcgtatacggcaccttccagggaccgcccagctacccgcccccgcgcccgccgcccgtcggctttccacagcccgccccgccgccgggcctctccgcctaccaccgcggcggctaccaggccgtttccggtgtgcgaggacatagccatgatcgacttccctgttgtggcattggttttggctggttcctgttcatattcggtttcttccttggtgccattccctggtacattggagcccttctgctatggtgttccagagttgattacagggagaaaccaggctatgtcgcatgcacagtagcggctatcctcgctacaattgctgttatcattggggcggcagctggaactcatgtttttttattttag

SEQ ID NO: 2808 - protein, 137 aa, Sorghum bicolor
  misc_feature: Ceres Annot ID no. 8658234
  misc_feature (1)..(137): Bit score of 199.1 for hmm based on sequences of FIGURE 09.
  misc_feature: Functional Homolog Of SEQ ID NO. 218
MSGEEADGSKPHQGGVYGTFQGPPSYPPPRPPPVGFPQPAPPPGLSAYHRGGYQAVSGVRGHSHDRLPCCGIGFGWFLFIFGFFLGAIPWYIGALLLWCSRVDYREKPGYVACTVAAILATIAVIIGAAAGTHVFLF

SEQ ID NO: 2809 - DNA, 624 bp, Sorghum bicolor
  misc_feature: Ceres Annot ID no. 8667981
  misc_feature: Encodes the peptide sequence at SEQ ID NO. 2810
atgggtggccagatgccggacgccgacgagaaggcccgctcggcggacacctcctcgtcctcttacggctacccgccgtcggcgccgccgcagcaccagcaccagtacggcaccttcgggcccccgtccggggcctctgggcagtttccgcagccggcggtcgggttcccccagccggcgccgccgcccggtatgcagcactacccgcagcagccgccggcgtcgtatgcggtctacccgcccccgcagcaaccctacgcggccgccgcgccgtactacgcccaaggctaccaggtcgcgcaaggttatattcctgttgttgaaggaaggcctgttagaatgcgacctcttccatgttgtggccttggcatgggatggtttctgtttatacttgggttcttctttgctgccattccatggtatattggagcttttggagaaaccaggatatgttgcttgcactattgctgcttcgcttgctgcaattgctgtgctgcttggcgccacaaaaggagcggaggtgtggtgagaattatgccttcaatcaccagcggtctgtttaatgtaaatgtttgttactcggctactttgttatctgtgttgtacatgccgtgttgtgcgtag

SEQ ID NO: 2810 - protein, 207 aa, Sorghum bicolor
  misc_feature: Ceres Annot ID no. 8667981
  misc_feature (1)..(207): Bit score of 194.8 for hmm based on sequences of FIGURE 09.
  misc_feature: Functional Homolog Of SEQ ID NO. 218
MGGQMPDADEKARSADTSSSSYGYPPSAPPQHQHQYGTFGPPSGASGQFPQPAVGFPQPAPPPGMQHYPQQPPASYAVYPPPQQPYAAAAPYYAQGYQVAQGYIPVVEGRPVRMRPLPCCGLGMGWFLFILGFFFAAIPWYIGAFGETRICCLHYCCFACCNCCAAWRHKRSGGVVRIMPSITSGLFNVNVCYSATLLSVLYMPCCA

SEQ ID NO: 2811 - DNA, 837 bp, Panicum virgatum
  misc_feature: Ceres Clone ID no. 1761087
  misc_feature: Encodes the peptide sequence at SEQ ID NO. 2812
atcactctccttccagatcccccaccgcgcgtctcccgctgcgacacgcacgcacgcctcacctcgtcgcctccgtcaacggtcaacccaccgcccatgggaggagggcacgagcaggaggccgacgccggcaaggccgggggctactcctcctccggcctcccgccgtcggagccgccgcacctgtcgggccagccgccgcagcagtacgggtacggcacgttccagggctctcgcgccggctcgggcgagttccggcagccgcccgtcgggttcccgcagcccgccccgcctcccggattcggcggcggcggcggcggcggctaccacaaccagcagcagccctacgcgcctgcggagccgtactacgcccaggggtaccaggccgtaccaggctatggtcaagtagctgaaggaagacctgtgagaatgcggcgtctcccatgttgtggcctcggcttaggctggttcctgttcatcaccggttttttccttgccgccattccatggtatgttggagcttttattatgatatgtgtgcgggtacatgaccatagagagaaaccaggatacgtagcctgcacaatcgctgccgcaattgctgcagttgccatcctcctgggggttactaaaggaactcacgtatggtgaattgcctccggagtccagagttttggcaatggccaaatgcaacccatcgatatattgcytgtttgtattgtatatatatatatatatatatatatatatatatatatatatatatatatgtatatatatatatatgtatatatatatatatctatatatatatatatatgtatatcgcgctggcgc

SEQ ID NO: 2812 - protein, 184 aa, Panicum virgatum
  misc_feature: Ceres Clone ID no. 1761087
  misc_feature (1)..(184): Bit score of 406.4 for hmm based on sequences of FIGURE 09.
  misc_feature: Functional Homolog Of SEQ ID NO. 218
MGGGHEQEADAGKAGGYSSSGLPPSEPPHLSGQPPQQYGYGTFQGSRAGSGEFRQPPVGFPQPAPPPGFGGGGGGGYHNQQQPYAPAEPYYAQGYQAVPGYGQVAEGRPVRMRRLPCCGLGLGWFLFITGFFLAAIPWYVGAFIMICVRVHDHREKPGYVACTIAAAIAAVAILLGVTKGTHVW

SEQ ID NO: 2813 - DNA, 773 bp, Glycine max
  misc_feature: Ceres Clone ID no. 612056
  misc_feature: Encodes the peptide sequence at SEQ ID NO. 2814
aaaacacaacgacgccactccccagatcaaagaactatttctctcgcgccagtcaaaaaccctctcagagaaagcacacaacaaagatgaccgacgaagacaaacccaaagccttctccggcggccatcacaaccaccctccgccgcagccacaacccttccccgccgcccagtatggcaccttccaaggcgtcgccaactaccctccgccgcagccgcaccccgccatcggcttccctcacccggttccgccgcccggcgccgtcgactcctccgcccctcctccgccctactacccgggctaccaagccgttcccggttatgcagttgctgaaggaagacctgtaagagaacgccgccttggttgctgtggccttggatgcggctggtgtctgtttatattaggcttctttcttgctggcattccgtggtatgttggggcaataattatgctttgttccagagtagactatcgagagaaacccggatatattgcttgtgtagttgctgctgttctgggcacaattgcaattattcttggtgtgacagagggagtagatgactggtaatcttcatgtcaagagttgtgtaaagtttgttagacgagtggtgtatgtaaagtgaaacagttgctgaaaattatgtctgagttcgatttatgtgttcattgagaactgctaccatatgtgatatgaattgtttgatttattacaaggttctcctagtcctgactaaagatatatatgatggggcaagacttgatatttgtatgg

SEQ ID NO: 2814 - protein, 160 aa, Glycine max
  misc_feature: Ceres Clone ID no. 612056
  misc_feature (1)..(160): Bit score of 269.6 for hmm based on sequences of FIGURE 09.
  misc_feature: Functional Homolog Of SEQ ID NO. 218
MTDEDKPKAFSGGHHNHPPPQPQPFPAAQYGTFQGVANYPPPQPHPAIGFPHPVPPPGAVDSSAPPPPYYPGYQAVPGYAVAEGRPVRERRLGCCGLGCGWCLFILGFFLAGIPWYVGAIIMLCSRVDYREKPGYIACVVAAVLGTIAIILGVTEGVDDW

SEQ ID NO: 2815 - DNA, 924 bp, Triticum aestivum
  misc_feature: Ceres Clone ID no. 678018
  misc_feature: Encodes the peptide sequence at SEQ ID NO. 2816
cctctctgtcaccgccagcttccacacacctcgtcggcacggaacaccgcccctcgagtcaagagtcaacccacacccaccgatctccgtccatcgaccatgggagccggccaggacctggaggccggcgccggcgacggcggcgagaagaagatggcccactcctcctcctcgggcccgctcccgccgtcggagccgccgcacctgcggggccaggaccccgcccagtaccagtatggtaccttccacccccctgccccccaccccgacgtccgcccccacccgcccgtcggcttcccccaacccgcgcctccccccggattcgccgccggcggctaccagcagcagcagcagaagcagccctacgcgcccgccgacccctactacgcgcaggggtaccaggccgccccaggttatggtcctgttgttcaaggtaggcctgttgaaggaagacccgtgagaatgcggcgccttccatgctgtgggctcggcatgggctggcttctgttcattgccgggttcttcttggctgccattccgtggtatattggtgctttcgtcctaatctgtgtccgggtacatgaccacagagagaaaccaggatatgttgcctgcactgttgctgctataattgcggccattgttataccccttggagtaacaaaaggaacagactcatggtgagccaccaccaggtcttggcaggcggttctgttgctgaatataaacatcgttatttcaggcccagttacatgataggttaaaaagtctgctggttgtatttcatgtatgagtgtgtcttgtatacatatatgtacagtaaaaagagtggggctgcatcttcgatgttctcttgtatcgatacttggtacttatagtgtgtaataaaagcttgaatgtacaacacatatcttcctcgaggct

SEQ ID NO: 2816 - protein, 194 aa, Triticum aestivum
  misc_feature: Ceres Clone ID no. 678018
  misc_feature (1)..(194): Bit score of 343.3 for hmm based on sequences of FIGURE 09.
  misc_feature: Functional Homolog Of SEQ ID NO. 218
MGAGQDLEAGAGDGGEKKMAHSSSSGPLPPSEPPHLRGQDPAQYQYGTFHPPAPHPDVRPHPPVGFPQPAPPPGFAAGGYQQQQQKQPYAPADPYYAQGYQAAPGYGPVVQGRPVEGRPVRMRRLPCCGLGMGWLLFIAGFFLAAIPWYIGAFVLICVRVHDHREKPGYVACTVAAIIAAIVIPLGVTKGTDSW

SEQ ID NO: 2817 - DNA, 482 bp, Brassica napus
  misc_feature: Ceres Clone ID no. 871875
  misc_feature: Encodes the peptide sequence at SEQ ID NO. 2818
accgtctcatcagatcaaacaaattgttcactgatctgagagagatagagatgacgagcatcgaagatgacaaaaacagatcagtgcagcctcctccgtttcaaggcgcctccaactatccacagcagccgcccgctggttatccacagccggctcagccctacgtctccggttatgctgtaaatgggctaacagaagagcaacgtcgtcttccttgttgtggtataggcattggttggttattattcatccttggtttcttcttcggtgctatcccctggtacattggcttcttccttttactatgctctagaaatccgcgtgagaaaccaggatatatagcttgtacaattggagctgttattgccacgggtttcatcgtttttggagctataagaggatccggggtctggtagtaaagtgaaatgtagtgctccaaatccggtacagaccggttcgggagatactggtgcataaggaag

SEQ ID NO: 2818 - protein, 121 aa, Brassica napus
  misc_feature: Ceres Clone ID no. 871875
  misc_feature (1)..(121): Bit score of 113.8 for hmm based on sequences of FIGURE 09.
  misc_feature: Functional Homolog Of SEQ ID NO. 218
MTSIEDDKNRSVQPPPFQGASNYPQQPPAGYPQPAQPYVSGYAVNGLTEEQRRLPCCGIGIGWLLFILGFFFGAIPWYIGFFLLLCSRNPREKPGYIACTIGAVIATGFIVFGAIRGSGVW

SEQ ID NO: 2819 - DNA, 515 bp, Triticum aestivum
  misc_feature: Ceres Clone ID no. 928713
  misc_feature: Encodes the peptide sequence at SEQ ID NO. 2820
agttacgagcggagtgaggcgaggcaggaggagagatgagcggggacgaggttgcgaaggccaaggctgccgccgccggcgtcggcggcgtaggggagtacgggacgttccatggtccgcccagctacccgcccccgcgcccgcccgtcgggcacccgcagcccgccccgccgcccggcctccacggccagcgcgagcccaactcgcgccaccgcggcgggtaccaggccgggaacgctcaagattacgaagcaggtgcccgtggacataaacatgaccgccttccatgctttggtattggcatgggatggtttctattcgtactcggtttctttcttggtgccatcccctggtatgtcggagcatttctgttgtggtgttccagagtggattacagggagaaaccaggatatgtggcatgcacaatagcggctgtccttgctacaattgccgtcatcatcggggcaactgctggagctcacgtttattgatgtcagtctacattgtgtcaytgt

SEQ ID NO: 2820 - protein, 151 aa, Triticum aestivum
  misc_feature: Ceres Clone ID no. 928713
  misc_feature (1)..(151): Bit score of 191.0 for hmm based on sequences of FIGURE 09.
  misc_feature: Functional Homolog Of SEQ ID NO. 218
MSGDEVAKAKAAAAGVGGVGEYGTFHGPPSYPPPRPPVGHPQPAPPPGLHGQREPNSRHRGGYQAGNAQDYEAGARGHKHDRLPCFGIGMGWFLFVLGFFLGAIPWYVGAFLLWCSRVDYREKPGYVACTIAAVLATIAVIIGATAGAHVY

SEQ ID NO: 2821 - DNA, 508 bp, Brassica napus
  misc_feature: Ceres Clone ID no. 963841
  misc_feature: Encodes the peptide sequence at SEQ ID NO. 2822
atctcaatctcgatttgagacgaaaaggaagagaagctgaagctaaagatgggtcaaggagaagaagacaaaagcaaaggcttcgctgatgaagcaggcacccatcatcagtacggtacgtttcaaggcgtttccaattaccctcctccgcggcctcagaactctcctccggtcactgggtttcctcagccttctgctccgcctcgagtctacgattccgcccctcctcattacgcccatggttatcaaaccgttccggtacatggtattgctgaaggaagacctgtgcatgtgcgacaacgccgccttccttgctgtggaattggtcttggatggttcctgttcatagttgggtttttccttggagcaatcccttggtacgtcggaatgttcatcatgatagttggaaggaggattgaccacagggagaagccaggatacattgcttgcaccatcgctgctatacttgcaacaattgctgtgattcttggtgtaactaaaggagcag

SEQ ID NO: 2822 - protein, 153 aa, Brassica napus
  misc_feature: Ceres Clone ID no. 963841
  misc_feature (1)..(153): Bit score of 299.3 for hmm based on sequences of FIGURE 09.
  misc_feature: Functional Homolog Of SEQ ID NO. 218
MGQGEEDKSKGFADEAGTHHQYGTFQGVSNYPPPRPQNSPPVTGFPQPSAPPRVYDSAPPHYAHGYQTVPVHGIAEGRPVHVRQRRLPCCGIGLGWFLFIVGFFLGAIPWYVGMFIMIVGRRIDHREKPGYIACTIAAILATIAVILGVTKGA

SEQ ID NO: 2823 - DNA, 690 bp, Brassica napus
  misc_feature: Ceres Clone ID no. 968767
  misc_feature: Encodes the peptide sequence at SEQ ID NO. 2824
accataatcagaggaagattgtttttgtttattgatccgaaaagagagatgaccagcggcggcgtagtagaagacgagaaaaacagatcagttgcgaatgattatcaacaccagcagcagcctcctcatcctccgccgtttcaaggtgtctccaactatccacctcctcagcagcagccacctccccccggttatccacagccagctcagccctacgtctccggttatgctgttaatggagtaacagagcacgatcgtcttccgtgttgtggaataggcattggttggttattattcatccttggtttcttcttcggtgccatcccctggtacatcggctttttccttttcctattctctagaaacccgcgtgagaaaccaggatacatagcttgtgcaattggagctgttattgctacgattttcatcgttattggagctgtaagaggatcaggggcctggtcttaaagtgaagacttgacgctcctaatccggtagagaccgattagggcgttgaggwactgttrttgcaaaagaagattgtacatgtgtgtttaagacctcaatgtatattgtttaaagattacagtcgaccatggcatttgtttacttaccaaaaaatgttcatctccaaaccgtagtaatgtgtttaaattttaaaattatatatatacatatatgatttgtgtg

SEQ ID NO: 2824 - protein, 139 aa, Brassica napus
  misc_feature: Ceres Clone ID no. 968767
  misc_feature (1)..(139): Bit score of 121.8 for hmm based on sequences of FIGURE 09.
  misc_feature: Functional Homolog Of SEQ ID NO. 218
MTSGGVVEDEKNRSVANDYQHQQQPPHPPPFQGVSNYPPPQQQPPPPGYPQPAQPYVSGYAVNGVTEHDRLPCCGIGIGWLLFILGFFFGAIPWYIGFFLFLFSRNPREKPGYIACAIGAVIATIFIVIGAVRGSGAWS

SEQ ID NO: 2825 - DNA, 723 bp, Brassica napus
  misc_feature: Ceres Clone ID no. 973750
  misc_feature: Encodes the peptide sequence at SEQ ID NO. 2826
aattgtttcaacgcgttgcaaaatatctaatctctattcgagtcaagagagcgatcgagacgaaaaggaagagaagctgaagctgaagctaaagatgggtcaaggagaagaagacaaaagcaaaggcttcgctgatgaagcaggtacccagcatcatcatcatcatcaatacggtacgtttcaaggcgtttccaattaccctcctccgcggccgcagaactctcctccggtcactgggtttcctcagccttctgctccgcctggagtgtacgattccgcccctcctcattacgcacatggctatcaaaccgttccggtacatggtattgctgaaggaagacctgtgcatgtgcgacaacgccgccttccttgctgtggaattggtcttgggtggttcctgttcatagttgggtttttccttggagcaatcccttggtacgtcggaatgttcatcatgatagttggaaggaggatcgaccacagggagaagccaggatacatttgcttgcaccatcgctgctattcttgctacgatcgctgtgattctgggtgtaactaaaggagcagaagactggtgatcaatcaaaactatgtttgtggtcaagtcagaacgtttgtataggtgtcgacaaacatttcgtcttgtattttattatattcgtggtacttgaagaaagacaaaaaggtgtaaacttaataaaagatacgagttaagttatttgc

SEQ ID NO: 2826 - protein, 154 aa, Brassica napus
  misc_feature: Ceres Clone ID no. 973750
  misc_feature (1)..(154): Bit score of 229.2 for hmm based on sequences of FIGURE 09.
  misc_feature: Functional Homolog Of SEQ ID NO. 218
MGQGEEDKSKGFADEAGTQHHHHHQYGTFQGVSNYPPPRPQNSPPVTGFPQPSAPPGVYDSAPPHYAHGYQTVPVHGIAEGRPVHVRQRRLPCCGIGLGWFLFIVGFFLGAIPWYVGMFIMIVGRRIDHREKPGYICLHHRCYSCYDRCDSGCN

SEQ ID NO: 2827 - protein, 153 aa, Picea sitchensis
  misc_feature: Public GI ID no. 116785437
  misc_feature (1)..(153): Bit score of 219.3 for hmm based on sequences of FIGURE 09.
  misc_feature: Functional Homolog Of SEQ ID NO. 218
MKGDSQSDENTRVVPGQAYYGTFQGADNYPQQPVMGIPQPVPPPGAVGSETYYPHGYQAVPGYPSPQVYPPVVEADVVPVRERRLPCCGIGLGWALFIIGFFLASIPWYVGAFLLLCVRQDYREKPGLLACTIAAILSAVAVIIGATKGANVW

SEQ ID NO: 2828 - protein, 156 aa, Populus balsamifera subsp. trichocarpa
  misc_feature: Public GI ID no. 118486768
  misc_feature (1)..(156): Bit score of 311.5 for hmm based on sequences of FIGURE 09.
  misc_feature: Functional Homolog Of SEQ ID NO. 218
MSDQEKNRGVVVDHRHHEDQPPPPPPPQPQYGTFQGVANYPPPSQSHVIGFPQPVPPPGITAEPYAQGYQTVPGYAVAEGRPVRQRRLPCCGCGVGWFLFIIGFFLGAIPWYIGLFIIACMRIDPREKPGYVACTIAAILATIAIILGATKGADEW

SEQ ID NO: 2829 - protein, 141 aa, Vitis vinifera
  misc_feature: Public GI ID no. 147767588
  misc_feature (1)..(141): Bit score of 226.8 for hmm based on sequences of FIGURE 09.
  misc_feature: Functional Homolog Of SEQ ID NO. 218
MSEESKNRSDQHYGTFQGVPTYSQPPAVGFPQPVPPPGAAEPSAPPPPPPQYYAHGYQAVPGYAVAEGTPVRERRLPCCGIGLGWFLFIIGFFLAAVPWYVGFFLLLCARVDYREKPGYIACTIAVSKLYCSFDFNFMEDV

SEQ ID NO: 2830 - protein, 145 aa, Vitis vinifera
  misc_feature: Public GI ID no. 147843376
  misc_feature (1)..(145): Bit score of 263.4 for hmm based on sequences of FIGURE 09.
  misc_feature: Functional Homolog Of SEQ ID NO. 218
MSEEGKSRGLSGQQSNQIPYGTFQGVANYPPLPPAHHPQPVIGIPQPVPPPGYYSHGYQTVPGYAVVEGRPVRERRLPCCGIGIGWLLFIIGFFCAAIPWYIGAFILLCVRVDYREKPGLIACTIATVLAVIAITLGVTKGTHAW

SEQ ID NO: 2831 - protein, 163 aa, Lupinus albus
  misc_feature: Public GI ID no. 156972242
  misc_feature (1)..(163): Bit score of 254.6 for hmm based on sequences of FIGURE 09.
  misc_feature: Functional Homolog Of SEQ ID NO. 218
MTEEDKPAVVLHHHHQPPPLSYPQPYPPPQYGTFQGVSNYPPPPPDLHPAIGFPQPAPPHGFTNQSPPPPPYYTHGYQAVPGYAVAEGRPVSERRLPFCGLGCGWFLFMFGFLLAGIPWYVGAILMLCSRVDYREKPGYVACIVAAVLYAIAIIFGVTKGGDD

SEQ ID NO: 2832 - protein, 143 aa, Vitis vinifera
  misc_feature: Public GI ID no. 157359699
  misc_feature (1)..(143): Bit score of 263.7 for hmm based on sequences of FIGURE 09.
  misc_feature: Functional Homolog Of SEQ ID NO. 218
MSEESKNRSDQHYGTFQGVPTYSQPPAVGFPQPVPPPGAAEPSAPPPPPPQYYAHGYQAVPGYAVAEGTPVRERRLPCCGIGLGWFLFIIGFFLAAVPWYVGFFLLLCARVDYREKPGYIACTIAAILATIAIIFGVTKGTGE

SEQ ID NO: 2833 - protein, 169 aa, Zea mays
  misc_feature: Public GI ID no. 194703738
  misc_feature (1)..(169): Bit score of 375.8 for hmm based on sequences of FIGURE 09.
  misc_feature: Functional Homolog Of SEQ ID NO. 218
MEGRREPEADGGKAGGLPPSEPPHLQGQPPQEYGYGTFQGPRHPPVGFPQPAPPPGLGSGGYHNQQQPYAPAETYYAQGYQAVPGYGPVAEGRPVRMRRLPCCGLGLGWCLFITGFFLAAIPWFIGAFVLICVRVHDQREKPGYVACTIAAVVAAVAILLGVTKGTHVW

SEQ ID NO: 2834 - DNA, 443 bp, Brassica napus
  misc_feature: Ceres Clone ID no. 1091017
  misc_feature: Encodes the peptide sequence at SEQ ID NO. 2835
  misc_feature (144)..(144): n is a, c, t, g, unknown, or other
tttctcggtctcgcctcgtttcacgaatctcgtctctattcctcaggtcttttagatcgatcggatctgaatcatggacgaggaggcagcaaaacctagagacaccaccataaaccagcaacaacaatactattacggaacgtntcaaggcgttgcaaattatcctcctcccgctccgccaccgcttccgcatcaacctattgtcacgagtcccttgcttcctcctgtacatggtcatggtggtggatttgtgaattacgctcaaggataccctgttgttcctgaatatacagtggttgaggtgagaccggtgagagagcatgacgttccttgctgtggctttggcatgggctggttcttgtttattatgggcttcttgttcggtgggatcccttggtatctcggtgctgttattattcttttcacctcagttgatcatcgcg

SEQ ID NO: 2835 - protein, 123 aa, Brassica napus
  misc_feature: Ceres Clone ID no. 1091017
  misc_feature (1)..(123): Bit score of 140.6 for hmm based on sequences of FIGURE 09.
  misc_feature: Functional Homolog Of SEQ ID NO. 218
  misc_feature (24)..(24): Xaa is any aa, unknown, or other
MDEEAAKPRDTTINQQQQYYYGTXQGVANYPPPAPPPLPHQPIVTSPLLPPVHGHGGGFVNYAQGYPVVPEYTVVEVRPVREHDVPCCGFGMGWFLFIMGFLFGGIPWYLGAVIILFTSVDHR

SEQ ID NO: 2836 - DNA, 1416 bp, Solanum lycopersicum
  misc_feature: Ceres Annot ID no. 8456541
  misc_feature: Encodes the peptide sequence at SEQ ID NO. 2837
atgactgttgaggtgcaatgtgaggcaactcaagtggctgaagtagttgttccacaagaggaattagtggctgctaacaaggttgtggaggaggttgaggtgaatgagaaggtaaaagaagatgaagaagaggaatccaagcctaatacaattgagaaaagctcttcttatagagaagagagcaacttcctctctgatctcaaagagaatgagaagaaggcattgaatgagttgaaatctatagttgaggaggccattgttgggaacactctattcaaaaaagaagagaccaacaagtctctagaggaagagggaaagaatgaggaaaatcccgatgcgaatatagaggagaaggagggtgatttggatgttgttgaagtggatagagagatttctatttggggtgtacccattttgcctagcaaaggggatgagaaaaccaatgtggttctattgaaattcttgagagcaagggattacaaagtgaatgaatctttcgaaatgctcaagaaaacactccagtggaggaaggattttaatatccaatccatcttggaggaagatttgggctcagatcttgcaccagctgcttacatgagtggggttgataaccaaggacaccctatttgttacaacattttcggcgttttggaagatgaagagatttataacaaaacgttcgggacagaggagaaacggaatcagttcttgaggtggagagttcagttaatggagaagggcattcagcagcttgatttcaaagctggaggtgttagttcactgcttcagataaatgatctgaagaactcgcctggaccgtctaagaaagaagtcagggttgcaaccaaacaagccgttgatcttcttcaggataactatcctgaatttgttgccaaaaatatattcatcaatgttccattttggtattacgccgtgcactctctgctgtcgcctttcctaacacaaagaaccaaaagcaaattcgtatttgctcgccctgctaaggtcactgagaccttgctcaagtacattccaatccatgaaatccctattcaatatggtggactcaagagggagaatgactttgagttttcagcctccgactgtgaagcttcggagattctccttaaagctggatcaattgaaactattgaaatacctgcagtagatgtggaaagtacatttatctgggatgttacgattgtgggcggagaagtgagctataaggaggaatttgtgccagaggatgagacttcttacactataatcattcagaaggacaagaaggtgagctcgacaattcgcaacacgttcaagaacactgaagcaggaaaggttgtgctgacaatcaagaacacttctagcaagaagaagaaggcgttttatcgacacaagatcaccaaatcaacaatttga

SEQ ID NO: 2837 - protein, 471 aa, Solanum lycopersicum
  misc_feature: Ceres Annot ID no. 8456541
  misc_feature (1)..(471): Bit score of 710.2 for hmm based on sequences of FIGURE 54.
  misc_feature (196)..(381): Pfam Name: CRAL_TRIO Pfam Description: CRAL/TRIO domain
  misc_feature (108)..(184): Pfam Name: CRAL_TRIO_N Pfam Description: CRAL/TRIO, N-terminus
  misc_feature (390)..(466): Pfam Name: EMP24_GP25L Pfam Description: emp24/gp25L/p24 family/GOLD
  misc_feature: Functional Homolog Of SEQ ID NO. 1554
MTVEVQCEATQVAEVVVPQEELVAANKVVEEVEVNEKVKEDEEEESKPNTIEKSSSYREESNFLSDLKENEKKALNELKSIVEEAIVGNTLFKKEETNKSLEEEGKNEENPDANIEEKEGDLDVVEVDREISIWGVPILPSKGDEKTNVVLLKFLRARDYKVNESFEMLKKTLQWRKDFNIQSILEEDLGSDLAPAAYMSGVDNQGHPICYNIFGVLEDEEIYNKTFGTEEKRNQFLRWRVQLMEKGIQQLDFKAGGVSSLLQINDLKNSPGPSKKEVRVATKQAVDLLQDNYPEFVAKNIFINVPFWYYAVHSLLSPFLTQRTKSKFVFARPAKVTETLLKYIPIHEIPIQYGGLKRENDFEFSASDCEASEILLKAGSIETIEIPAVDVESTFIWDVTIVGGEVSYKEEFVPEDETSYTIIIQKDKKVSSTIRNTFKNTEAGKVVLTIKNTSSKKKKAFYRHKITKSTI

SEQ ID NO: 2838 - DNA, 1698 bp, Sorghum bicolor
  misc_feature: Ceres Annot ID no. 8692801
  misc_feature: Encodes the peptide sequence at SEQ ID NO. 2839
atgacagaggagctgcagccagagtccgccggcgccgagcttgtcgtgaccgaggcggcgctggtagaggcggaggtgcctgcggcggcgaaagccgaagccgaggccgaggcggagaagacagctgatgaggccgcagtcaccgccgatgactcgggggaggagaccggatcgttcaaggaggagagcaacctggtggacgacctgcccgacccgcagaagcagcaggcgctcgacgagttcaagcagctgatcgctgccgccctcgccgccggtgagttcaacctgcctcccccgctgccgccgccgaaggccaaggaggaacctaacgccgaggagacgaagacggaggaacccaagaacgaggagccagccaaagaagagcccaaggccgaggccgaggctgcggatgccccggttgatgaggtcaagacggaggtgccgccggccgaggaggccaaggctgagacggtggccgaggaagccaagccttccgagcccgaggcgcaggagaagaccgtcgtgttcgctgtggaggagatcgaggaaaccgtcgtgtccgccgccgccgccgccacctcggaggaggcagcggcgccggaggtggtggccgagactcaggcggccgcgcctgagcccgtgctgatctggggcgtgccgctggtgggcgacgatgagcgcacggacacggttctgctcaagttcctgcgagcgcgggagttcaaggtgaaggaggccatggcgatgctcaagtccacagtgctgtggcgcgagcgctttggtatcacctcgctcctcgacgacgacctcggcctgccggagctggagaacgtggtgttctaccgcggcacggaccgcgagggccaccctgtctgctacaacgtctacggcgaattccaggacaaggatctctacgagaggaccttcggcgacgatgagaagcgggagcgcttcctcaagtggcgcatccagctgctggagcgcggcatcctgtcgaagctggatttctcgcccggcggcatctgctccatggttcaggttaccgacctcaagaactcgccgcccatgctccgcaagcaccggtccgtcacccgccaggccgtcgcgctgctccaagacaactatcccgagttcattgccaagaaggtgttcatcaatgtgccgtggtggtatttcgctgccaacaagatgatgagcccgttcctcacacagcgcaccaagagcaagtttgtctttgctaccccagccaagtcagcagagactctattaagatacatcgcaccggaacaagttcctgtccaatttggaggcctcttcaaggagaacgatcctgagttcaccacctccgacactgtcactgagctcactgtcgaaccctcatcgaaagaaaccattgagatccctgtcaccgagaactccacaattacatgggaactccaggtgctcggttgggaggtgagctatggcgccgagttcacccctgacactgtgggtgggtatgctgtcattgtccaaaaaacaaggaaggcaggcgagcccgggaaactcgtgctaactgtgaataaccctgcatccaagaagaagaagctcctttacagatcaaagacgaagcgcgctccaccgcgcccgcccctgctatgctctcctgctatacgctctactgggttagcttctttttacttctggtgccctgaataa

SEQ ID NO: 2839 - protein, 565 aa, Sorghum bicolor
  misc_feature: Ceres Annot ID no. 8692801
  misc_feature (1)..(565): Bit score of 1013.8 for hmm based on sequences of FIGURE 54.
  misc_feature (278)..(464): Pfam Name: CRAL_TRIO Pfam Description: CRAL/TRIO domain
  misc_feature (197)..(265): Pfam Name: CRAL_TRIO_N Pfam Description: CRAL/TRIO, N-terminus
  misc_feature: Functional Homolog Of SEQ ID NO. 1554
MTEELQPESAGAELVVTEAALVEAEVPAAAKAEAEAEAEKTADEAAVTADDSGEETGSFKEESNLVDDLPDPQKQQALDEFKQLIAAALAAGEFNLPPPLPPPKAKEEPNAEETKTEEPKNEEPAKEEPKAEAEAADAPVDEVKTEVPPAEEAKAETVAEEAKPSEPEAQEKTVVFAVEEIEETVVSAAAAATSEEAAAPEVVAETQAAAPEPVLIWGVPLVGDDERTDTVLLKFLRAREFKVKEAMAMLKSTVLWRERFGITSLLDDDLGLPELENVVFYRGTDREGHPVCYNVYGEFQDKDLYERTFGDDEKRERFLKWRIQLLERGILSKLDFSPGGICSMVQVTDLKNSPPMLRKHRSVTRQAVALLQDNYPEFIAKKVFINVPWWYFAANKMMSPFLTQRTKSKFVFATPAKSAETLLRYIAPEQVPVQFGGLFKENDPEFTTSDTVTELTVEPSSKETIEIPVTENSTITWELQVLGWEVSYGAEFTPDTVGGYAVIVQKTRKAGEPGKLVLTVNNPASKKKKLLYRSKTKRAPPRPPLLCSPAIRSTGLASFYFWCPE

SEQ ID NO: 2840 - DNA, 1820 bp, Zea mays
  misc_feature: Ceres Clone ID no. 240809
  misc_feature: Encodes the peptide sequence at SEQ ID NO. 2841
acagtcccactcctctctctctcgcgctctctctctttcatcgccaccaccgccgtgaaatccgcacgcgtgcttcctgtcgatttttgagctgtgactgtgagcgccatggccgtggaggctgtgtccggaaatggcaccgaggcagtggccgcggcgccggcgaaggaggtgagcaccaagcaggcgtctttccgggaggagagcaacttcctggacgatctcaaggagagcgagcgtaaggcgcttgccgagctccgcgacaaggtcgaggcggccatcgtggagggcaagctgttcgacgacggtaagccggaggtgaaggagaaggagaaggagaaggaggaggccaagaagaaggcagtggagaagaaagatgagcagcccgaagccgaggagaagggagaggaggatgacaagaaggaggccgacgccgaggaggagaagaaggaaggcgtggaggaaggggagaagaaggaaggccaggaggaaggggagaaggaggaggccgaggaggagagcggagacgacaccaagcaggaggccaaggaagaggaagccgacgacaaggcggcggcgaaggagccggagacggcggccgttgtcgtcgacaaggacatcgcgctgtggggcgtgcctttgctccctagcaagggcgacgaggccaccgacgtggtgctcctcaagttcctccgcgcgcgcgacttcaaggccggcgccgcgttcgagatgctccgccgcacgctccgctggcgcagggactggaccggcttcagctccggcgccgagtccgacgccgacctccccgaggagctcgcgggcgcgtgctacctcgacggcgcagaccacgagggccacccggtgtgctacaacgcgctgggcgtgttcgcggacgacgccgtgtacaagaaggcgctgggcaccgaggaaggcaaggccaggttcctccggtggcgggtgcgcgccatggagcgccacgtcgccgagctggacctgaggcccggcggcgtcgcgtcgctgctgcaggtgatcgacctcaggaactcgccggggccggccaagaaggacttccgagtcgccgtcaagcaggtgctcgacctgttccaggacaactaccccgagctcgtcgcgagaaacatcttggtcaacgtgccgttctggtactacgcgttcagcaccctgttctacccgttcctgacgcagaggacgaagagcaagttcgtcgttgctcgcccgtcaaaggtcaccgagaccctcctcaagtacattccgatcgaggccatcccggtgaagtacggcggcctgaagcgcgacggcgacaccgagttctcggcggacgacggcgaggtcgcggaggtcaccgtcaagggaagctccacggagaccatcgagatcgaagctactgaggctgatgccacgctgacatgggacctgactgtgctggggtgggaggtgaactacaaggaggagttcgtgccggcggacgagggctcctacactatcatcgtcaggaaaggcaagaagatggcgtccggcgaggaggcggtccgcaactcgttccgcgccggcgagccgggcaaggtcgtgctcaccgtccagaacacctcgcacaggaagaagaaggtgctgttcaggcacaaggccaagagcgcctgcgccaagaagtgctgagaggctaagaaatttgggagtgaaattggttgtggatttcaatattcgttacattctttgtgtgtgtgtaaggagagagagagagaacattgttcgctgattatttgaggtggttgttgcagcaaaaatgcaaagagttttcgattgat

SEQ ID NO: 2841 - protein, 520 aa, Zea mays
  misc_feature: Ceres Clone ID no. 240809
  misc_feature (1)..(520): Bit score of 898.8 for hmm based on sequences of FIGURE 54.
  misc_feature (239)..(423): Pfam Name: CRAL_TRIO Pfam Description: CRAL/TRIO domain
  misc_feature (432)..(512): Pfam Name: EMP24_GP25L Pfam Description: emp24/gp25L/p24 family/GOLD
  misc_feature (144)..(221): Pfam Name: CRAL_TRIO_N Pfam Description: CRAL/TRIO, N-terminus
  misc_feature: Functional Homolog Of SEQ ID NO. 1554
MAVEAVSGNGTEAVAAAPAKEVSTKQASFREESNFLDDLKESERKALAELRDKVEAAIVEGKLFDDGKPEVKEKEKEKEEAKKKAVEKKDEQPEAEEKGEEDDKKEADAEEEKKEGVEEGEKKEGQEEGEKEEAEEESGDDTKQEAKEEEADDKAAAKEPETAAVVVDKDIALWGVPLLPSKGDEATDVVLLKFLRARDFKAGAAFEMLRRTLRWRRDWTGFSSGAESDADLPEELAGACYLDGADHEGHPVCYNALGVFADDAVYKKALGTEEGKARFLRWRVRAMERHVAELDLRPGGVASLLQVIDLRNSPGPAKKDFRVAVKQVLDLFQDNYPELVARNILVNVPFWYYAFSTLFYPFLTQRTKSKFVVARPSKVTETLLKYIPIEAIPVKYGGLKRDGDTEFSADDGEVAEVTVKGSSTETIEIEATEADATLTWDLTVLGWEVNYKEEFVPADEGSYTIIVRKGKKMASGEEAVRNSFRAGEPGKVVLTVQNTSHRKKKVLFRHKAKSACAKKC

SEQ ID NO: 2842 - DNA, 2130 bp, Zea mays
  misc_feature: Ceres Clone ID no. 325220
  misc_feature: Encodes the peptide sequence at SEQ ID NO. 2843
ataacacaacaatctctctcccctcactccctctctgcagcgcgcagytttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggccgaggagcccgccaaagaagagcccscgkcckaggcggaggaagccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgccggaggcggtggtcgaggctcaggcgaccgcgcctgaacccgtgctgatttggggcgtgccgctggtcggcgacgacgagcgcacggacacggttctgctcaagttcctgcgtgcgcgggagttcaaggtgaaggaggccatggcgatgctcaagtccgcggtgctgtggcgcaagcgcttcggcatcacctcgctcctcgacgccgaccttggcctgacggagctggagaacgtggtgttctaccgcggcacggaccgcgaaggccaccccgtgtgctacaacgtctacggcgagttccaggacaaggatctctacgagaaggccttcggcgacgatgagaagagggagcgcttcctcaagtggcgcatccagctgctggagcgcggcattctgtcgaagctggacttctcgcccagcggcatctgctccatggttcaggttaccgacctcaagaactcgccgcccatgctcggcaagcaccgcgccgtcacccgccaggctgtcacgctgctccaggacaactaccccgagttcattgccaagaaggtgttcatcaatgtgccgtggtggtatctagccgccaacaagatgatgagcccgttcctcacacagcgcaccaagagcaagttcgtctttgctagcccagccaaatcagcagcgactctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggcgagcctggaaaacttgtgctaactgtgaacaaccctgcatccaagaagaagactctactttacagatcgaaggtgaagagcgccagcgagtgagtgtgaggtcacgccgctagctgcctgggccctacagttaaaacgatctacagcatgatagaagagagaaggaaccttttggtttggttcgttaatttactgggatttgctgggttttttattttttgggttcgcattctacattttgtttggttgaaaccaaagtgagcttgtttttgtgacagtagatgggagaagtataatggcattgtgtgatggatggttgttgatgagggcagggaggacgaaaatgaggggaaggaaaggctggagaatgtctgttcctctgtagatgtgtgttctgtacattgcatctcttggattctcattgatatgttaaaatttaggagtacttggtc

SEQ ID NO: 2843 - protein, 567 aa, Zea mays
  misc_feature: Ceres Clone ID no. 325220
  misc_feature (1)..(567): Bit score of 1154.3 for hmm based on sequences of FIGURE 54.
  misc_feature (481)..(562): Pfam Name: EMP24_GP25L Pfam Description: emp24/gp25L/p24 family/GOLD
  misc_feature (290)..(477): Pfam Name: CRAL_TRIO Pfam Description: CRAL/TRIO domain
  misc_feature (213)..(277): Pfam Name: CRAL_TRIO_N Pfam Description: CRAL/TRIO, N-terminus
  misc_feature: Functional Homolog Of SEQ ID NO. 1554
  misc_feature (129)..(129): Xaa is any aa, unknown, or other
  misc_feature (130)..(130): Xaa is any aa, unknown, or other
  misc_feature (131)..(131): Xaa is any aa, unknown, or other
MAEETQPEAAAAAAPAAAEVVVTEAAPAEAEVPAAAEAEAEAKDEKKGDEAELTADDAGVGTGSFKEESNLVEDLPDPEKKALDEFKQLIAAALAAGEFNLPPPPPPPKAKETKVEEAKAEEPAKEEPXXXAEEAKAQVAADAPVEEVKTEVPPAEEAKAETLAEEAKPSEPEPQEKTVVVTEEETATKTVEAIEETVVSAPAAIPEEAAAPEAVVEAQATAPEPVLIWGVPLVGDDERTDTVLLKFLRAREFKVKEAMAMLKSAVLWRKRFGITSLLDADLGLTELENVVFYRGTDREGHPVCYNVYGEFQDKDLYEKAFGDDEKRERFLKWRIQLLERGILSKLDFSPSGICSMVQVTDLKNSPPMLGKHRAVTRQAVTLLQDNYPEFIAKKVFINVPWWYLAANKMMSPFLTQRTKSKFVFASPAKSAATLFRYIAPEQVPVQFGGLFKEDDPEFTTSDTVSELTIKPSSKETVEIPVTENSTIVWELRVLSWEVSYGAEFTPDAEGGYTVIVQKTRKVPANEEPIMKGSFKAGEPGKLVLTVNNPASKKKTLLYRSKVKSASE

SEQ ID NO: 2844 - DNA, 1594 bp, Glycine max
  misc_feature: Ceres Clone ID no. 525937
  misc_feature: Encodes the peptide sequence at SEQ ID NO. 2845
aaaaaccgaagaggagcaagctgaaacaaaggaggaagaggaaaagaaggaggaagtgaaagaaacgaatgaagaagctgcggtggatgatgatggagcaaaaactgtggaggccattgaagagaccgttgttgctgtctcttctaccgttcagcctcaagctgaagagaaagcttcatcgccacttccacctgaagaggtttccatttgggggataccgctgcttgcagatgagaggagcgatgtgattctgctgaagtttctgcgcgcgagggagttcagggtgaaggaggcattcaccatgctgaagaacacgatccagtggaggaaggagtttgggatggaggagttgatggaggagaagctcggggatgagttggagaaggtggtgttcatgcatggctttgacaaggagggtcaccctgtgtgttacaacatctatggggagttccagaacaaggagttgtacaagaagactttttctgatgaggagaagagggagaagttcctgaggtggagaattcagttcctggagaagagtataaggaagctggatttcaaccctggtggcatatgcaccattgttcatgttaatgacctcaagaattcccctggacttgccaagtgggaacttagacaagccaccaaacatgccctacaattgcttcaagacaattaccctgaatttgttgccaaacaggtgtttattaatgtgccatggtggtacctggcagtgaataggatgataagcccttttcttactcagaggaccaaaagcaagtttgtctttgctgggccttccaaatcaacggaaacccttttgagatacatagctccggagcagcttcccgtgaagtacggtggactaagcaaagatggggagttcggaaatatcgatgctgtcacagaaatcacagtgaggccggcagcaaaacattcggtggaattttcagttactgagaactgcttactctcttgggagcttagagtaataggttgggaagtaacttatggggcagaatttgtgccaagctcagaaggaagctacacagtaattgtccagaaggctagaaaggttgcttcatcagaagaaccagtgctttgcaacagttttaaggttggtgaacctgggaaagttgttctcaccattgacaacacaagctctaagaagaagaagctcttgtatcgcttgaagaccaagccttccccttctgactaaaatcatcattgttatgtgtatgtgcaagtgggaaggggaagaacagtgccagaattgcttgcttacattcctgcatcaacttctaccaagacaccagtgcttcaaagattaactttccagctgttcatatatgaatataaagtttttgtttttaattttttggcctttttgttttgatgattattatgtgttcaaccatattatataattatatatacctctttctgtgtttttcttgctatgattatttattgttgttgttatcactgaagataaatatcaaggtccttctttcaaatttggggtatcttttgagttgttcttagggagggacttgttggctgttgccctatttgtatgttataaatatcatgc

SEQ ID NO: 2845 - protein, 405 aa, Glycine max
  misc_feature: Ceres Clone ID no. 525937
  misc_feature (1)..(405): Bit score of 813.3 for hmm based on sequences of FIGURE 54.
  misc_feature (129)..(313): Pfam Name: CRAL_TRIO Pfam Description: CRAL/TRIO domain
  misc_feature (318)..(399): Pfam Name: EMP24_GP25L Pfam Description: emp24/gp25L/p24 family/GOLD
  misc_feature (56)..(117): Pfam Name: CRAL_TRIO_N Pfam Description: CRAL/TRIO, N-terminus
  misc_feature: Functional Homolog Of SEQ ID NO. 1554
KTEEEQAETKEEEEKKEEVKETNEEAAVDDDGAKTVEAIEETVVAVSSTVQPQAEEKASSPLPPEEVSIWGIPLLADERSDVILLKFLRAREFRVKEAFTMLKNTIQWRKEFGMEELMEEKLGDELEKVVFMHGFDKEGHPVCYNIYGEFQNKELYKKTFSDEEKREKFLRWRIQFLEKSIRKLDFNPGGICTIVHVNDLKNSPGLAKWELRQATKHALQLLQDNYPEFVAKQVFINVPWWYLAVNRMISPFLTQRTKSKFVFAGPSKSTETLLRYIAPEQLPVKYGGLSKDGEFGNIDAVTEITVRPAAKHSVEFSVTENCLLSWELRVIGWEVTYGAEFVPSSEGSYTVIVQKARKVASSEEPVLCNSFKVGEPGKVVLTIDNTSSKKKKLLYRLKTKPSPSD

SEQ ID NO: 2846 - protein, 564 aa, Vitis vinifera
  misc_feature: Public GI ID no. 147801354
  misc_feature (1)..(564): Bit score of 695.3 for hmm based on sequences of FIGURE 54.
  misc_feature (276)..(457): Pfam Name: CRAL_TRIO Pfam Description: CRAL/TRIO domain
  misc_feature (172)..(264): Pfam Name: CRAL_TRIO_N Pfam Description: CRAL/TRIO, N-terminus
  misc_feature: Functional Homolog Of SEQ ID NO. 1554
  misc_feature (550)..(550): Xaa is any aa, unknown, or other
MAEEAIPKEIQVAKDEVPQKQEPSKKDVEVEGAATGDVKDAEKDGDSKKFNDPKPGLAALIDDEKENEGVSKDSVVDSLVAERGASFQEESNLPSDLKDLEKKALLDLRSKIEDAIRSNTLFEEEKKQAEEAEKARSPEKEGEEKEKSVVNEGQGEEKKPEELAVEEGKEEEKPENLGFNGEKNETKQKEEEQEKINIEIGKKAIEVDEEIKLWGVPLLPSKGDKGTDVILLKFLRAREFKVQEAFEMLRNTLKWIKDNNIDIILEEEFPPELSSVAYMQGMDRKGHPICYNIFGTFLNDEIYNKTFGTEELRHKFLRWRFQLMERGIKKLDFGSGGATSMLQVNDLRNSPGPTKKELRQAMKQAVGLLQDNYPEFVSRNIFINVPFWSYAFYAVVSPFFTQRSKNKFDFARPARVTETLLKYIDAQQIPVGYGGFHRENDPDFSIEDGVSEVIIKGGSSGAIAIPAPEVGTKFTWEITVLGWDVNYREEFVPKDEGSYTMIVQKERKVGWEEGAIRNSFTNKEAGMLVLTIDNATFKKKRVLYRYKPIXTSTTTTTPSSSTTT

SEQ ID NO: 2847 - protein, 591 aa, Vitis vinifera
  misc_feature: Public GI ID no. 147859031
  misc_feature (1)..(591): Bit score of 1013.7 for hmm based on sequences of FIGURE 54.
  misc_feature (250)..(436): Pfam Name: CRAL_TRIO Pfam Description: CRAL/TRIO domain
  misc_feature (151)..(238): Pfam Name: CRAL_TRIO_N Pfam Description: CRAL/TRIO, N-terminus
  misc_feature (444)..(525): Pfam Name: EMP24_GP25L Pfam Description: emp24/gp25L/p24 family/GOLD
  misc_feature: Functional Homolog Of SEQ ID NO. 1554
MADETDAAPPPTLLAAASVVPPETAAPPETAASEEVLTVLDVAPPVTEKEVSPQKPPPPPEEVVAVVDSEKKVPQNLVSFKEESNRLADLSESERRALEELKQSVQEALRNGIFTSQPQPPPPPPPPQSAEKPPEKIEEASEKREPNPVAESEISTQEESAKDENVKPTPNPTIESILKHESPTQEDVSIWGIPLLKDERSDMILLKFLRAREFKVKEAFAMLKNTIFWRKEFGIDALVDDDLGEHLEKVVFMHGFDRDGHPVCYNVYGEFQNKELYQKTFSDEEKRMKFLRWRIQFLERSIRKLDFTPGGVNTIFQVNDLKNSPGPGKWELRQATKQALQLLQDNYPEFVAKQVFINVPWWYLAFYMMISPFLTQRTKSKFVFASPAKSAKTLFKYISPEQVPIQYGGLSVDYCDCNPDFGIADPVTEITVKPSTKQTVEILVSEQCVIVWEVRVVGWEVAYGAEFIPDAEDEYTVVVQKATKMAPTDDPVMCNSFKIKELGKIVITIDNPTSKKKKLLYRFKTPECHIEVQFNIQSAEDYTTHSNRVYATRLASLHSSGDISKIRRRLTAGGDRDLTYSHSGPRIACWE

SEQ ID NO: 2848 - protein, 595 aa, Vitis vinifera
  misc_feature: Public GI ID no. 147859032
  misc_feature (1)..(595): Bit score of 978.3 for hmm based on sequences of FIGURE 54.
  misc_feature (315)..(504): Pfam Name: CRAL_TRIO Pfam Description: CRAL/TRIO domain
  misc_feature (511)..(591): Pfam Name: EMP24_GP25L Pfam Description: emp24/gp25L/p24 family/GOLD
  misc_feature (258)..(318): Pfam Name: CRAL_TRIO_N Pfam Description: CRAL/TRIO, N-terminus
  misc_feature: Functional Homolog Of SEQ ID NO. 1554
  misc_feature (483)..(483): Xaa is any aa, unknown, or other
  misc_feature (522)..(522): Xaa is any aa, unknown, or other
MAEDGKKPVSEEAQKPVAEASVVEEVVAVAEVTAPPPAVPEAEEAAEKLKEEEEVVEKLEEEVAAAEEEKPKVVEEGEKMTESVSFKEESNVVGDLPESQRKALEELKVLVREALEKHEFTAPPPPPPPPAKEEEKAPATEEEPKTEAPAEPAPEVVCPPPVEESEKKEEKEEEKKEEEKKEEEKKEEEKVAPPEPAEPVVVAAVVETVTAVVVDEDGTKTVEAIEETIVVAPPAPPAEEAAAVVEEVTPPPPAEEVPPPPPPPPEEVEIWGIKLFDDDRTDVVLLKFLRARDFKPKEALTMLKNTVLWRKSFGIETLLGDDLGNPPGRAWLCYNAYGKFLNKELYQNTFSDEEKRQNFLRWRIQFLEKSIRKLDFSPNGINTIIQVNDLKNSPGPFKRELRQSTNQALHLLQDNYPEFVAKQIFINVPWWYLAFNRMISPFLTQRTKSKFVFAGPSKSAETLFKYIAPEQVPVQYGGLKRDXDTEFSICDPVTLVTIKPGCKHVIEFPYSEPCQLIWELRXIGWDVTYGAEFVPTVEGGYTVIVQKARKIAPTDEPVISNSFKIGEPGKVILTIDNQTSKKKKLLYRSKTQPCD

SEQ ID NO: 2849 - protein, 493 aa, Vitis vinifera
  misc_feature: Public GI ID no. 147864826
  misc_feature (1)..(493): Bit score of 773.7 for hmm based on sequences of FIGURE 54.
  misc_feature (214)..(399): Pfam Name: CRAL_TRIO Pfam Description: CRAL/TRIO domain
  misc_feature (131)..(202): Pfam Name: CRAL_TRIO_N Pfam Description: CRAL/TRIO, N-terminus
  misc_feature (408)..(487): Pfam Name: EMP24_GP25L Pfam Description: emp24/gp25L/p24 family/GOLD
  misc_feature: Functional Homolog Of SEQ ID NO. 1554
  misc_feature (106)..(106): Xaa is any aa, unknown, or other
  misc_feature (369)..(369): Xaa is any aa, unknown, or other
MTVESVEAVEVKAEDTQMTEVSVSLPEEEKAVEKVNEAKPKTVEKSSSYREESNFLSDLKDNENKALIELRSKLEEAILRNTLFKKEELKKETASESKEEQPAAAXKKEKEPEATDGAAPEEAEPKTEGEDKQSSSEVEKPEEVVDRDITLWGVPLLPSKCAEGNDVILLKFLRAREFKVNEAFEMLKKTLEWRKEFKTDSILEEELGQDISSVAYMNGVDREGHPICYNIYGVLENQELYQKTFGTEEKRNQFLRWRIQLMEKGIQKLDFKPGGVTSLLQINDLSNSPGPSKKEIRIATKQAVGLLQDNYPEFVARNIFINVPFWYYALNALLSPFLTQRTKSKFVFVRPSKVTETLLKYICVEEIPXQYGGLKREKDTEFSIEDGGVTELVVKAGSTETIEIPVPEVGTTLVWDLTVLGWEVNYKEEFVPADEGSYTIIIQKGKKMGSQEEPVRNSFLNNEPGKVVLTIENSVSKKKRIFYRYKTKNCSSF

SEQ ID NO: 2850 - protein, 493 aa, Vitis vinifera
  misc_feature: Public GI ID no. 157351635
  misc_feature (1)..(493): Bit score of 787.9 for hmm based on sequences of FIGURE 54.
  misc_feature (214)..(399): Pfam Name: CRAL_TRIO Pfam Description: CRAL/TRIO domain
  misc_feature (131)..(202): Pfam Name: CRAL_TRIO_N Pfam Description: CRAL/TRIO, N-terminus
  misc_feature (408)..(487): Pfam Name: EMP24_GP25L Pfam Description: emp24/gp25L/p24 family/GOLD
  misc_feature: Functional Homolog Of SEQ ID NO. 1554
MTVESVEAVEVKAEDTQMTEVSVSLPEEEKAVEKVNEAKPKTVEKSSSYREESNFLSDLKDNENKALIELRSKLEEAILRNTLFKKEELKKETASEPKEEQPAAAEEKEKEPEATDGAAPEEAEPKTEGEDKQSSSEVEKPEEVVDRDITLWGVPLLPSKCAEGNDVILLKFLRAREFKVNEAFEMLKKTLEWRKEFKTDSILEEELGQDISSVAYMNGVDREGHPICYNIYGVLENQELYQKTFGTEEKRNQFLRWRIQLMEKGIQKLDFKPGGVTSLLQINDLSNSPGPSKKEIRIATKQAVGLLQDNYPEFVARNIFINVPFWYYALNALLSPFLTQRTKSKFVFVRPSKVTETLLKYICVEEIPVQYGGLKREKDTEFSIEDGGVTELVVKAGSTETIEIPVPEVGTTLVWDLTVLGWEVNYKEEFVPADEGSYTIIIQKGKKMGSQEEPVRNSFRNNEPGKVVLTIENSVSKKKRIFYRYKTKNCSSF

SEQ ID NO: 2851 - protein, 564 aa, Vitis vinifera
  misc_feature: Public GI ID no. 157354577
  misc_feature (1)..(564): Bit score of 696.7 for hmm based on sequences of FIGURE 54.
  misc_feature (276)..(457): Pfam Name: CRAL_TRIO Pfam Description: CRAL/TRIO domain
  misc_feature (172)..(264): Pfam Name: CRAL_TRIO_N Pfam Description: CRAL/TRIO, N-terminus
  misc_feature: Functional Homolog Of SEQ ID NO. 1554
MAEEAIPKEIQVAKDEVPQKQEPSKKDVEVEGAATGDVKDAEKDGDSKKFNDPKPGLAALIDDEKENEGVSKDSVVDSLVAERGASFQEESNLPSDLKDLEKKALLDLRSKIEDAIRSNTLFEEEKKQAEEAEKARSPEKEGEEKEKSVVNEGQGEEKKPEELAVEEGKEEEKPENLGFNGEKNETKQKEEEQEKINIEIGKKAIEVDEEIKLWGVPLLPSKGDKGTDVILLKFLRAREFKVQEAFEMLRNTLKWIKDNNIDIILEEEFPPELSSVAYMQGMDRKGHPICYNIFGTFLNDEIYNKTFGTEELRHKFLRWRFQLMERGIKKLDFGSGGATSMLQVNDLRNSPGPTKKELRQAMKQAVGLLQDNYPEFVSRNIFINVPFWSYAFYAVVSPFFTQRSKNKFDFARPARVTETLLKYIDAQQIPVGYGGFHRENDPDFSIEDGVSEVIIKGGSSGAIAIPAPEVGTKFTWEITVLGWDVNYREEFVPKDEGSYTMIVQKERKVGWEEGAIRNSFTNKEAGMLVLTIDNATFKKKRVLYRYKPNSTSTTTTTPSSSTTT

SEQ ID NO: 2852 - protein, 606 aa, Vitis vinifera
  misc_feature: Public GI ID no. 157357697
  misc_feature (1)..(606): Bit score of 1062.9 for hmm based on sequences of FIGURE 54.
  misc_feature (330)..(502): Pfam Name: CRAL_TRIO Pfam Description: CRAL/TRIO domain
  misc_feature (522)..(602): Pfam Name: EMP24_GP25L Pfam Description: emp24/gp25L/p24 family/GOLD
  misc_feature (258)..(318): Pfam Name: CRAL_TRIO_N Pfam Description: CRAL/TRIO, N-terminus
  misc_feature: Functional Homolog Of SEQ ID NO. 1554
MAEDGKKPVSEEAQKPVAEASVVEEVVAVAEVTAPPPAVPEAEEAAEKLKEEEEVVEKLEEEVAAAEEEKPKVVEEGEKMTESVSFKEESNVVGDLPESQRKALEELKVLVREALEKHEFTAPPPPPPPPAKEEEKAPATEEEPKTEAPAEPAPEVVCPPPVEESEKKEEKEEEKKEEEKKEEEKKEEEKVAPPEPAEPVVVAAVVETVTAVVVDEDGTKTVEAIEETIVVAPPAPPAEEAAAVVEEVTPPPPAEEVPPPPPPPPEEVEIWGIKLFDDDRTDVVLLKFLRARDFKPKEALTMLKNTVLWRKSFGIETLLGDDLGTHLESVVFMEGSGKEGHPVCYNAYGKFLNKELYQNTFSDEEKRQNFLRWRIQFLEKSIRKLDFSPNGINTIIQVNDLKNSPGPFKRELRQSTNQALHLLQDNYPEFVAKQIFINVPWWYLAFNRMISPFLTQRTKSKFVFAGPSKSAETLFKYIAPEQVPVQYGGLKRDGDTEFSICDPVTLVTIKPGCKHVIEFPYSEPCQLIWELRVIGWDVTYGAEFVPTVEGGYTVIVQKARKIAPTDEPVISNSFKIGEPGKVILTIDNQTSKKKKLLYRSKTQPCD
